(12) United States Patent
Altshuler et al.

(10) Patent No.: US 12,024,728 B2
(45) Date of Patent: Jul. 2, 2024

(54) METHODS AND COMPOSITIONS FOR MODULATING A GENOME

(71) Applicant: Flagship Pioneering Innovations VI, LLC, Cambridge, MA (US)

(72) Inventors: Robert Charles Altshuler, Newton, MA (US); Anne Helen Bothmer, Cambridge, MA (US); Cecilia Giovanna Silvia Cotta-Ramusino, Cambridge, MA (US); Randi Michelle Kotlar, Arlington, MA (US); Ananya Ray, Melrose, MA (US); Nathaniel Roquet, Philadelphia, PA (US); Carlos Sanchez, Cambridge, MA (US); Barrett Ethan Steinberg, Somerville, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 0 days.

(21) Appl. No.: 18/356,013

(22) Filed: Jul. 20, 2023

(65) Prior Publication Data
US 2024/0002822 A1     Jan. 4, 2024

Related U.S. Application Data

(63) Continuation of application No. PCT/US2022/076045, filed on Sep. 7, 2022.

(60) Provisional application No. 63/373,444, filed on Aug. 24, 2022, provisional application No. 63/241,953, filed on Sep. 8, 2021.

(51) Int. Cl.
*C12N 9/22* (2006.01)
*C12N 9/12* (2006.01)
*C12N 15/10* (2006.01)
*C12N 15/11* (2006.01)
*C12N 15/90* (2006.01)

(52) U.S. Cl.
CPC .............. *C12N 9/22* (2013.01); *C12N 9/1276* (2013.01); *C12N 15/1082* (2013.01); *C12N 15/11* (2013.01); *C12N 15/907* (2013.01); *C12Y 207/07049* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 4,797,368 A | 1/1989 | Carter et al. |
| 5,173,414 A | 12/1992 | Lebkowski et al. |
| 5,789,538 A | 8/1998 | Rebar et al. |
| 5,846,946 A | 12/1998 | Huebner et al. |
| 5,925,523 A | 7/1999 | Dove et al. |
| 6,007,988 A | 12/1999 | Choo et al. |
| 6,013,453 A | 1/2000 | Choo et al. |
| 6,140,466 A | 10/2000 | Barbas, III et al. |
| 6,200,759 B1 | 3/2001 | Dove et al. |
| 6,242,568 B1 | 6/2001 | Barbas, III et al. |
| 6,410,248 B1 | 6/2002 | Greisman et al. |
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,689,558 B2 | 2/2004 | Case |
| 6,693,086 B1 | 2/2004 | Dow et al. |
| 6,794,136 B1 | 9/2004 | Eisenberg et al. |
| 7,030,215 B2 | 4/2006 | Liu et al. |
| 7,067,317 B2 | 6/2006 | Rebar et al. |
| 7,070,934 B2 | 7/2006 | Cox, III et al. |
| 7,070,941 B2 | 7/2006 | Zhao et al. |
| 7,169,874 B2 | 1/2007 | Salamone et al. |
| 7,253,273 B2 | 8/2007 | Collingwood |
| 7,262,054 B2 | 8/2007 | Jamieson et al. |
| 7,361,635 B2 | 4/2008 | Miller et al. |
| 7,375,234 B2 | 5/2008 | Sharpless et al. |
| 8,158,601 B2 | 4/2012 | Chen et al. |
| 8,168,775 B2 | 5/2012 | Sah et al. |
| 8,394,604 B2 | 3/2013 | Liu et al. |
| 8,404,658 B2 | 3/2013 | Hajjar et al. |
| 8,454,972 B2 | 6/2013 | Nabel et al. |
| 9,267,932 B2 | 2/2016 | Boeke et al. |
| 9,663,770 B2 | 5/2017 | Rogers |
| 10,300,146 B2 | 5/2019 | Gao et al. |
| 10,378,026 B2 * | 8/2019 | Scharenberg .......... C12N 15/86 |

(Continued)

FOREIGN PATENT DOCUMENTS

| | | |
|---|---|---|
| GB | 2338237 B | 2/2001 |
| WO | 9324641 A2 | 12/1993 |

(Continued)

OTHER PUBLICATIONS

Liu, P., Liang, S.Q., Zheng, C., Mintzer, E., Zhao, Y.G., Ponnienselvan, K., Mir, A., Sontheimer, E.J., Gao, G., Flotte, T.R. and Wolfe, S.A., 2021. Improved prime editors enable pathogenic allele correction and cancer modelling in adult mice. Nature communications, 12(1), p. 2121. (Year: 2021).*

(Continued)

*Primary Examiner* — Neil P Hammell
*Assistant Examiner* — Khaleda B Hasan
(74) *Attorney, Agent, or Firm* — K&L Gates LLP

(57) ABSTRACT

The disclosure provides, e.g., compositions, systems, and methods for targeting, editing, modifying, or manipulating a host cell's genome at one or more locations in a DNA sequence in a cell, tissue, or subject.

26 Claims, 26 Drawing Sheets
Specification includes a Sequence Listing.

(56) References Cited

U.S. PATENT DOCUMENTS

| | | | |
|---|---|---|---|
| 10,947,517 B2 * | 3/2021 | Chen | C12N 15/102 |
| 11,193,123 B2 | 12/2021 | Halperin | |
| 11,447,770 B1 | 9/2022 | Liu et al. | |
| 2005/0064474 A1 | 3/2005 | Urnov et al. | |
| 2005/0267061 A1 | 12/2005 | Martin | |
| 2007/0218528 A1 | 9/2007 | Miller | |
| 2009/0162834 A1 | 6/2009 | Fishman | |
| 2011/0214199 A1 | 9/2011 | Coffin | |
| 2012/0164205 A1 | 6/2012 | Baum et al. | |
| 2013/0046084 A1 | 2/2013 | Brown et al. | |
| 2014/0011375 A1 | 1/2014 | Lin | |
| 2014/0186919 A1 * | 7/2014 | Zhang | C12N 15/86 435/320.1 |
| 2015/0344549 A1 | 12/2015 | Muir et al. | |
| 2016/0102322 A1 | 4/2016 | Ravinder et al. | |
| 2018/0028664 A1 | 2/2018 | Besin et al. | |
| 2018/0127780 A1 | 5/2018 | Liu et al. | |
| 2018/0346890 A1 | 12/2018 | Lambowitz et al. | |
| 2019/0078066 A1 | 3/2019 | Wang | |
| 2019/0119701 A1 | 4/2019 | Liang et al. | |
| 2019/0169639 A1 | 6/2019 | Zhang et al. | |
| 2019/0177735 A1 | 6/2019 | Sederoff et al. | |
| 2019/0225963 A1 | 7/2019 | Khalili et al. | |
| 2019/0255106 A1 | 8/2019 | Lande et al. | |
| 2019/0310251 A1 | 10/2019 | Tovey et al. | |
| 2019/0316121 A1 | 10/2019 | Smith et al. | |
| 2019/0322992 A1 | 10/2019 | Liu et al. | |
| 2020/0095589 A1 | 3/2020 | Voigt et al. | |
| 2020/0109398 A1 | 4/2020 | Rubens et al. | |
| 2020/0385720 A1 | 12/2020 | Cohnen et al. | |
| 2021/0077594 A1 | 3/2021 | In et al. | |
| 2021/0130835 A1 | 5/2021 | Watts et al. | |
| 2022/0282244 A1 | 9/2022 | May et al. | |
| 2022/0396813 A1 | 12/2022 | Feala et al. | |
| 2023/0131847 A1 | 4/2023 | Rubens et al. | |
| 2023/0235358 A1 | 7/2023 | Citorik et al. | |
| 2023/0242899 A1 | 8/2023 | Steinberg et al. | |
| 2023/0272430 A1 | 8/2023 | Bothmer et al. | |
| 2023/0332184 A1 | 10/2023 | Rubens et al. | |
| 2023/0348939 A1 | 11/2023 | Bothmer et al. | |

FOREIGN PATENT DOCUMENTS

| | | |
|---|---|---|
| WO | 9837186 A1 | 8/1998 |
| WO | 9853057 A1 | 11/1998 |
| WO | 0027878 A1 | 5/2000 |
| WO | 2001018048 A2 | 3/2001 |
| WO | 0188197 A2 | 11/2001 |
| WO | 2001092501 A1 | 12/2001 |
| WO | 2006008074 A1 | 1/2006 |
| WO | 2010086626 A1 | 8/2010 |
| WO | 2011064750 A1 | 6/2011 |
| WO | 2012123430 A1 | 9/2012 |
| WO | 2014136086 A1 | 9/2014 |
| WO | 2014150624 A1 | 9/2014 |
| WO | 2015095340 A1 | 6/2015 |
| WO | 2017099823 A1 | 6/2017 |
| WO | 2017132580 A2 | 8/2017 |
| WO | 2017173054 A1 | 10/2017 |
| WO | 2018002812 A1 | 1/2018 |
| WO | 2018071663 A1 | 4/2018 |
| WO | 2018081535 A2 | 5/2018 |
| WO | 2018089860 A1 | 5/2018 |
| WO | 2018106727 A1 | 6/2018 |
| WO | 2018170184 A1 | 9/2018 |
| WO | 2019005955 A1 | 1/2019 |
| WO | 2019040650 A1 | 2/2019 |
| WO | 2019067910 A1 | 4/2019 |
| WO | 2019067992 A1 | 4/2019 |
| WO | 2019070843 A1 | 4/2019 |
| WO | 2019113310 A1 | 6/2019 |
| WO | 2019123014 A1 | 6/2019 |
| WO | 2019169233 A1 | 9/2019 |
| WO | 2019178428 A1 | 9/2019 |
| WO | 2019186348 A1 | 10/2019 |
| WO | 2020014209 A1 | 1/2020 |
| WO | 2020033083 A1 | 2/2020 |
| WO | 2020051561 A1 | 3/2020 |
| WO | 2020112908 A2 | 6/2020 |
| WO | 2020160514 A1 | 8/2020 |
| WO | 2020191153 A9 | 9/2020 |
| WO | 2020191233 A1 | 9/2020 |
| WO | 2020191234 A1 | 9/2020 |
| WO | 2020191242 A1 | 9/2020 |
| WO | 2020191248 A1 | 9/2020 |
| WO | 2020191249 A1 | 9/2020 |
| WO | 2020252361 A1 | 12/2020 |
| WO | 2021042047 A1 | 3/2021 |
| WO | 2021062410 A2 | 4/2021 |
| WO | 2021080922 A1 | 4/2021 |
| WO | 2021133261 A1 | 7/2021 |
| WO | 2021138469 A1 | 7/2021 |
| WO | 2021188840 A1 | 9/2021 |
| WO | 2021204877 A2 | 10/2021 |
| WO | 2021226558 A1 | 11/2021 |
| WO | 2022129438 A1 | 6/2022 |
| WO | 2022150790 A2 | 7/2022 |
| WO | 2022155055 A1 | 7/2022 |
| WO | 2022155532 A1 | 7/2022 |
| WO | 2022158898 A1 | 7/2022 |
| WO | 2022170058 A1 | 8/2022 |
| WO | 2022173830 A1 | 8/2022 |
| WO | 2022212926 A1 | 10/2022 |
| WO | 2022256714 A2 | 12/2022 |
| WO | 2023004439 A2 | 1/2023 |
| WO | 2023283092 A1 | 1/2023 |
| WO | 2023015014 A1 | 2/2023 |
| WO | 2023015309 A2 | 2/2023 |
| WO | 2023015318 A2 | 2/2023 |
| WO | 2023039586 A1 | 3/2023 |
| WO | 2023060256 A1 | 4/2023 |
| WO | 2023070062 A2 | 4/2023 |
| WO | 2023086389 A1 | 5/2023 |
| WO | 2023086558 A1 | 5/2023 |
| WO | 2023086842 A1 | 5/2023 |
| WO | 2023096847 A2 | 6/2023 |
| WO | 2023096977 A2 | 6/2023 |
| WO | 2023192655 A2 | 10/2023 |

OTHER PUBLICATIONS

Patil et al., "Engineered nanocarriers of doxorubicin: a current update," Crit Rev Ther Drug Carrier Syst (2008) 25:1-61.

Paulk et al., "Bioengineered AAV Capsids with Combined High Human Liver Transduction In Vivo and Unique Humoral Seroreactivity," Mol. Ther. (2018) 26:289-303.

Paulsen et al.,"Ectopic expression of RAD52 and dn53BP1 improves homology-directed repair during CRISPR-Cas9 genome editing," Nat Biomed Eng (2017) vol. 1, No. 11, pp. 878-888.

Pawluk et al., "Anti-CRISPR: discovery, mechanism and function," Nature Reviews Microbiology (2018) vol. 16, pp. 12-17.

Peer and Lieberman, "Special delivery: targeted therapy with small RNAs," Gene Ther (2011) 18:1127-1133.

Peer et al., "Selective gene silencing in activated leukocytes by targeting siRNAs to the integrin lymphocyte function-associated antigen-1," PNAS (2007) 104:4095-4100.

Peer et al., "Systemic leukocyte-directed siRNA delivery revealing cyclin D1 as an anti-inflammatory target," Science (2008) 319:627-630.

Peer, "Induction of therapeutic gene silencing in leukocyte-implicated diseases by targeted and stabilized nanoparticles: a mini-review," J Control Release (2010) 20:63-68.

Pei et al.,"PROMALS3D: a tool for multiple protein sequence and structure alignments," Nucleic Acids Res (2008) vol. 36, No. 7, pp. 2295-2300.

Pellenz et al., "New human chromosomal safe harbor sites for genome engineering with CRISPR/Cas9, TAL effector and homing endonucleases, " Human Gene Therapy (2018) doi: 10.1101/396390, 39 pages.

(56) References Cited

OTHER PUBLICATIONS

Petek et al., "Frequent endonuclease cleavage at off-target locations in vivo," Mol. Ther. (2010) 18(5):983-986.
Petek et al., "Efficient KRT14 targeting and functional characterization of transplanted human keratinocytes for the treatment of epidermolysis bullosa simplex," Mol. Ther. (2010) 8(9):1624-1632.
Peterka et al., "Harnessing DSB repair to promote efficient homology-dependent and -independent prime editing," Biorxiv (Aug. 10, 2021) vol. , No. , pp. 2021.08.10.455572.
Peters et al.,"Recruitment of CRISPR-Cas systems by Tn7-like transposons," Proc National Acad Sci (2017) vol. 114, No. 35, pp. E7358-E7366.
Piccioli et al., "Neuroantibodies: ectopic expression of a recombinant anti-substance P antibody in the central nervous system of transgenic mice," Neuron (1995) 15:373-384.
Piccioli et al., "Neuroantibodies: molecular cloning of a monoclonal antibody against substance P for expression in the central nervous system," Proc. Natl. Acad. Sci. USA (1991) 88:5611-5615.
Platt et al., "Obesity-linked regulation of the adipsin gene promoter in transgenic mice," Proc. Natl. Acad. Sci. USA (1989) 86:7490-7494.
Ponnienselvan et al.,"Addressing the dNTP bottleneck restricting prime editing activity," bioRxiv (2023) vol. No. , pp. 2023.10.21. 563443.
Porteus et al.,"A New Class of Medicines through DNA Editing," New Engl J Med (2019) vol. 380, No. 10, pp. 947-959.
Protein Data Bank, PDB file: "5F9R, Crystal structure of catalytically-active Streptococcus pyogenes CRISPR-Cas9 in complex with single-guided RNA and double-stranded DNA primed for target DNA cleavage," deposited by Jiang et al. on Dec. 10, 2015.
Qian et al.,"Efficient and precise generation of Tay-Sachs disease model in rabbit by prime editing system," Cell Discov (Jul. 6, 2021) vol. 7, No. 1, pp. 50.
Qu et al., "Structure of a group II intron in complex with its reverse transcriptase," Nature Structural & Molecular Biology (2016) vol. 23, No. 6, pp. 549-557.
Radovick et al. "Migratory arrest of gonadotropin-releasing hormone neurons in transgenic mice," Proc. Natl. Acad. Sci. USA (1991) 88:3402-3406.
Ramadier et al.,"Combination of lentiviral and genome editing technologies for the treatment of sickle cell disease," Molecular Therapy (2022) vol. 30, No. 1, pp. 145-163.
Ran et al.,"Double Nicking by RNA-Guided CRISPR Cas9 for Enhanced Genome Editing Specificity," Cell (2013) vol. 154, No. 6, pp. 1380-1389.
Ravin et al., "The protelomerase of the phage-plasmid N15 is responsible for its maintenance in linear form," J Mol Biol 2001.
Rees et al.,"Development of hRad51-Cas9 nickase fusions that mediate HDR without double-stranded breaks," Nat Commun (2019) vol. 10, No. 1, pp. 2212.
Remacle et al., "New mode of DNA binding of multi-zinc finger transcription factors: deltaEF1 family members bind with two hands to two target sites," EMBO Journal (1999) 18(18):5073-5084.
Remih et al.,"Alpha1-antitrypsin deficiency: New therapies on the horizon," Current Opinion in Pharmacology (2021) vol. 59, No. , pp. 149-156.
Renaud et al.,"Improved Genome Editing Efficiency and Flexibility Using Modified Oligonucleotides with TALEN and CRISPR-Cas9 Nucleases," Cell Reports (2016) vol. 14, No. 9, pp. 2263-2272.
Richner et al., "Modified mRNA Vaccines Protect against Zika Virus Infection," Cell (2017) 168(6): P1114-1125.
Robbins et al., "In vivo definition of a cardiac specific promoter and its potential utility in remodeling the heart," Ann. N. Y. Acad. Sci. (1995) 752:492-505.
Rodriguez-Fornes et al., "Targeted gene therapy into a safe harbor site in human hematopoietic progenitor cells," Gene Therapy (2020) 27(9):435-450.
Ross et al., "A fat-specific enhancer is the primary determinant of gene expression for adipocyte P2 in vivo," Proc. Natl. Acad. Sci. USA (1990) 87:9590-9594.
Rothgangl et al.,"In vivo adenine base editing of PCSK9 in macaques reduces LDL cholesterol levels," Nat Biotechnol (May 19, 2021) vol. 39, No. 8, pp. 949-957.
Ruminski et al., "Processing and translation initiation of non-long terminal repeat retrotransposons by hepatitis delta virus (HDV)-like self-cleaving ribozymes," J Biol Chem (2011) 286: 41286-41295.
Rybarski et al., "Metagenomic Discovery of CRISPR-Associated Transposons," bioRxiv (2021) 13 pages.
Sabatini et al., "RAFT1: a mammalian protein that binds to FKBP12 in a rapamycin-dependent fashion and is homologous to yeast TORs," Cell (1994) 78(1):35-43.
Samulski et al., "Helper-free stocks of recombinant adeno-associated viruses: normal integration does not require viral gene expression," J. Virol. (1989) 63:03822-3828.
Sanford et al., "A novel role for shuttling SR proteins in mRNA translation," Genes & Development (2004) 18:755-768.
Sano et al.,"Mutations to create thermostable reverse transcriptase with bacterial family A DNA polymerase from Thermotoga petrophila K4," J Biosci Bioeng (2012) vol. 113, No. 3, pp. 315-321.
Sanz et al.,"High-resolution, strand-specific R-loop mapping via S9.6-based DNA:RNA immunoprecipitation and high-throughput sequencing," Nat Protoc (2019) vol. 14, No. 6, pp. 1734-1755.
Sapranauskas et al.,"The Streptococcus thermophilus CRISPR/Cas system provides immunity in Escherichia coli," Nucleic Acids Res (2011) vol. 39, No. 21, pp. 9275-9282.
Sartorelli et al., "Myocardial activation of the human cardiac alpha-actin promoter by helix-loop-helix proteins," Proc. Natl. Acad. Sci. USA (1992) 89:4047-4051.
Sasaoka et al., "Analysis of the human tyrosine hydroxylase promoter-chloramphenicol acetyltransferase chimeric gene expression in transgenic mice," Mol. Brain Res. (1992) 16:274-286.
Sato et al., "Dual promoter structure of mouse and human fatty acid translocase/CD36 genes and unique transcriptional activation by peroxisome proliferator-activated receptor alpha and gamma ligands," J. Biol. Chem. (2002) 277: 15703-15711.
Sato et al., "Efficiency of the pioneer round of translation affects the cellular site of nonsense-mediated mRNA decay," Molecular Cell (2008) 29: 255-262.
Schene et al.,"Prime editing for functional repair in patient-derived disease models," Nature Communications (2020) vol. 11, No. 1, pp. 5352.
Schmid-Burgk et al.,"Highly Parallel Profiling of Cas9 Variant Specificity," Mol Cell (2020) vol. 78, No. 4, pp. 794-800.e8.
Schmidt et al.,"Transcriptional recording by CRISPR spacer acquisition from RNA," Nature (2018) vol. 562, No. 7727, pp. 380-385.
Scholze et al., "TAL effector-DNA specificity," Virulence (2010) 1:5, 428-462.
Segal et al., "Custom DNA-binding proteins come of age: polydactyl zinc-finger proteins," Curr. Opin. Biotechnol. (2001) 12:632-637.
Segel et al.,"Mammalian retrovirus-like protein PEG10 packages its own mRNA and can be pseudotyped for mRNA delivery," Science (Aug. 19, 2021) vol. 373, No. 6557, pp. 882-889.
Seo et al., "Functional characterization of the human resistin promoter with adipocyte determination- and differentiation-dependent factor 1/sterol regulatory element binding protein 1c and CCAAT enhancer binding protein-alpha," Molec. Endocrinol. (2003) 17:1522-1533.
Shah et al., "Inteins: Nature's Gift to Protein Chemists," Chem Sci. (2014) 5(1):446-461.
Shams et al., "Comprehensive deletion landscape of CRISPR-Cas9 identifies minimal RNA-guided DNA-binding modules," BioRxiv (2020) 18 pages.
Sharan et al.,"Recombineering: a homologous recombination-based method of genetic engineering," Nat Protoc (2009) vol. 4, No. 2, pp. 206-223.
Sharon et al.,"Functional Genetic Variants Revealed by Massively Parallel Precise Genome Editing," Cell (2018) vol. 175, No. 2, pp. 544-557.e16.
Shcherbakova & Brenowitz, "Monitoring structural changes in nucleic acids with single residue spatial and millisecond time resolution by quantitative hydroxyl radical footprinting," Nature Protocols (2008) 3:288-302.

(56) References Cited

OTHER PUBLICATIONS

Shivram et al., "Targeting novel sites: The N-terminal DNA binding domain of non-LTR retrotransposons is an adaptable module that is implicated in changing site specificities," Mobile Genetic Elements (2011) vol. 1, No. 3, pp. 169-178.
Shukla et al., "High-throughput identification of RNA nuclear enrichment sequences," The EMBO Journal (2018) vol. 37, Article e98452, 11 pages.
Siegner et al.,"PnB Designer: a web application to design prime and base editor guide RNAs for animals and plants," Bmc Bioinformatics (Mar. 2, 2021) vol. 22, No. 1, pp. 101.
Simon et al.,"Retrons and their applications in genome engineering," Nucleic Acids Res (2019) vol. 47, No. 21, pp. 11007-11019.
Sixma et al.,"DNA mismatch repair: MutS structures bound to mismatches," Curr Opin Struc Biol (2001) vol. 11, No. 1, pp. 47-52.
Slade et al.,"Recombination and Replication in DNA Repair of Heavily Irradiated Deinococcus radiodurans," Cell (2009) vol. 136, No. 6, pp. 1044-1055.
Slaymaker et al.,"Engineering Cas9 for human genome editing," Curr Opin Struc Biol (May 5, 2021) vol. 69, No. , pp. 86-98.
Smyshlyaev et al.,"Acquisition of an Archaea-like ribonuclease H domain by plant L1 retrotransposons supports modular evolution," Proc National Acad Sci (2013) vol. 110, No. 50, pp. 20140-20145.
Song et al., "Antibody mediated in vivo delivery of small interfering RNAs via cell-surface receptors," Nat Biotechnol. (2005) 23:709-717.
Spuch and Navarro, "Liposomes for Targeted Delivery of Active Agents against Neurodegenerative Diseases (Alzheimer's Disease and Parkinson's Disease)," Journal of Drug Delivery, vol. 2011, Article ID 469679, 12 pages, 2011. doi:10.1155/2011/469679 for review.
Srinivasan et al., "Integrin-targeted stabilized nanoparticles for an efficient delivery of siRNAs in vitro and in vivo," Methods Mol Biol (2012) 820:105-116.
Stamos et al.,"Structure of a Thermostable Group II Intron Reverse Transcriptase with Template-Primer and Its Functional and Evolutionary Implications," Mol Cell (2017) vol. 68, No. 5, pp. 926-939.e4.
Standage-Beier et al.,"Prime Editing Guide RNA Design Automation Using Pine-Cone," ACS Synthetic Biology (2021) vol. 10, No. 2, pp. 422-427.
Stauber et al., "A signal regulating mouse histone H4 mRNA levels in a mammalian cell cycle mutant and sequences controlling RNA 3' processing are both contained within the same 80-bp fragment," EMBO Journal (1986) 5:3297-3303.
Stein et al., "The osteocalcin gene: a model for multiple parameters of skeletal-specific transcriptional control," Mol. Biol. Rep. (1997) 24:185-196.
Stevens et al., "Design of a Split Intein with Exceptional Protein Splicing Activity," J Am Chem Soc (2016) 138(7):2162-2165.
Storici et al.,"RNA-templated DNA repair," Nature (2007) vol. 447, No. 7142, pp. 338-341.
Strecker et al., "RNA-guided DNA insertion with CRISPR-associated transposases," Science (2019) vol. 365, No. 6448, pp. 48-53.
Strobel et al.,"High-throughput determination of RNA structures," Nat Rev Genet (2018) vol. 19, No. 10, pp. 615-634.
Su et al.,"Sequence-specific retrotransposition of 28S rDNA-specific LINE R2OI in human cells," Rna (2019) vol. 25, No. 11, pp. 1432-1438.
Subramanya et al., "Enhanced induction of HIV-specific cytotoxic T lymphocytes by dendritic cell-targeted delivery of SOCS-1 siRNA," Mol Ther (2010) 18:2028-2037.
Subtelny et al., "Poly(A)-tail profiling reveals an embryonic switch in translational control," Nature (2014) 508:66-71.
Sultana et al., "Integration site selection by retroviruses and transposable elements in eukaryotes," Nature Reviews Genetics (2017) doi: 10.1038/nrg.2017.7, 17 pages.
Sultana et al., "The Landscape of L1 Retrotransposons in the Human Genome Is Shaped by Pre-insertion Sequence Biases and Post-insertion Selection," Molecular Cell (2019) vol. 74, pp. 555-570.
Surun et al.,"Efficient Generation and Correction of Mutations in Human iPS Cells Utilizing mRNAs of CRISPR Base Editors and Prime Editors," Genes-basel (2020) vol. 11, No. 5, pp. 511.
Suzuki et al.,"In vivo genome editing via CRISPR/Cas9 mediated homology-independent targeted integration," Nature (2016) vol. 540, No. 7631, pp. 144-149.
Tabor et al., "Identification of conserved cis-elements and transcription factors required for sterol-regulated transcription of stearoyl-CoA desaturase 1 and 2," J. Biol. Chem. (1999) 274:20603-20610.
Taha et al.,"Delivery of CRISPR-Cas tools for in vivo genome editing therapy: Trends and challenges," Journal of Controlled Release (2022) vol. 342, No. , pp. 345-361.
Tang et al.,"Class 2 CRISPR/Cas: an expanding biotechnology toolbox for and beyond genome editing," Cell Biosci (2018) vol. 8, No. 1, pp. 59.
Tang et al.,"Structural basis of suppression of host translation termination by Moloney Murine Leukemia Virus," Nat Commun (2016) vol. 7, No. 1, pp. 12070.
Taylor et al.,"Affinity Proteomics Reveals Human Host Factors Implicated in Discrete Stages of LINE-1 Retrotransposition," Cell (2013) vol. 155, No. 5, pp. 1034-1048.
Templeton et al., "Improved DNA: liposome complexes for increased systemic delivery and gene expression," Nature Biotech, 15:647-652, 1997.
Thiel et al., "Infectious RNA transcribed in vitro from a cDNA the human coronavirus genome cloned in vaccinia virus," J Gen Virol (2001) 82(6):1273-1281.
Thompson et al., "Independently derived targeting of the 28S rDNA by A- and D-clade R2 retrotransposons," Mobile Genetic Elements (2011) vol. 1, pp. 29-37.
Tian et al.,"Co-Evolutionary Fitness Landscapes for Sequence Design," Angewandte Chemie Int Ed (2018) vol. 57, No. 20, pp. 5674-5678.
To et al.,"An overview of rational design of mRNA-based therapeutics and vaccines," Expert Opin Drug Dis (Jul. 19, 2021) vol. 16, No. 11, pp. 1307-1317.
Tong et al.,"CRISPR-nRAGE, a Cas9 nickase-reverse transcriptase assisted versatile genetic engineering toolkit for *E. coli*," Biorxiv (2020) vol. No. , pp. 2020.09.02.279141.
Tong et al.,"The Versatile Type V Crispr Effectors and Their Application Prospects," Frontiers Cell Dev Biology (Feb. 4, 2021) vol. 8, No. , pp. 622103.
Toro et al.,"The Reverse Transcriptases Associated with CRISPR-Cas Systems," Scientific Reports (2017) vol. 7, No. 1, pp. 7089.
Tozzo et al., "Amelioration of insulin resistance in streptozotocin diabetic mice by transgenic overexpression of GLUT4 driven by an adipose-specific promoter," Endocrinol. (1997) 138:1604-1611.
Tratschin et al., "A human parvovirus, adeno-associated virus, as a eucaryotic vector: transient expression and encapsidation of the procaryotic gene for chloramphenicol acetyltransferase," Mol. Cell. Biol. (1984) 4:2072-2081.
Miyoshi et al., "Poly(ADP-Ribose) Polymerase 2 Recruits Replication Protein A to Sites of LINE-1 Integration to Facilitate Retrotransposition," Molecular Cell (2019) vol. 75, pp. 1286-1298.
Moessler et al., "The SM 22 promoter directs tissue-specific expression in arterial but not in venous or visceral smooth muscle cells in transgenic mice," Development (1996) 122:2415-2425.
Mohr et al., "A Reverse Transcriptase-Cas1 Fusion Protein Contains a Cas6 Domain Required for Both CRISPR RNA Biogenesis and RNA Spacer Acquisition," Molecular Cell (2019) vol. 72, No. 4, pp. 700-714.
Mok et al.,"A bacterial cytidine deaminase toxin enables CRISPR-free mitochondrial base editing," Nature (2020) vol. 583, No. 7817, pp. 631-637.
Molina et al., "Engineering a Nickase on the Homing Endonuclease I-DmoI Scaffold," J Biol Chem (2015) vol. 290, No. 30, pp. 18534-18544.
Moore and Query, "Joining of RNAs by splinted ligation," Methods in Enzymology (2000) 317:109-123.

(56) References Cited

OTHER PUBLICATIONS

Moran et al.,"High Frequency Retrotransposition in Cultured Mammalian Cells," Cell (1996) vol. 87, No. 5, pp. 917-927.
Morris et al.,"Automated design of CRISPR prime editors for thousands of human pathogenic variants," Biorxiv (2020) vol. No. , pp. 2020.05.07.083444.
Morrison et al.,"The developing toolkit of continuous directed evolution," Nat Chem Biol (2020) vol. 16, No. 6, pp. 610-619.
Moss et al., "The R2 retrotransposon RNA families," RNA Biology (2011) vol. 8, No. 5, pp. 714-718.
Mukha et al., "Endonuclease domain of the Drosophila melanogaster R2 non-LTR retrotransposon and related retroelements- a new model for transposition," Frontiers in Genetics (2013) vol. 4, Article 63, 15 pages.
Mulepati et al., "Structural biology. Crystal structure of a CRISPR RNA-guided surveillance complex bound to a ssDNA target," Science (2014) vol. 345, Issue 6203, pp. 1479-1484.
Murugan et al.,"The Revolution Continues: Newly Discovered Systems Expand the CRISPR-Cas Toolkit," Mol Cell (2017) vol. 68, No. 1, pp. 15-25.
Musacchio and Torchilin, "Recent developments in lipid-based pharmaceutical nanocarriers," Front Biosci (2011) 16:1388-1412.
Musunuru et al.,"In vivo CRISPR base editing of PCSK9 durably lowers cholesterol in primates," Nature (2021) vol. 593, No. 7859, pp. 429-434.
Muzyczka, "Adeno-associated virus (AAV) vectors: will they work?," J. Clin. Invest. (1994) 94:1351.
Muzyczka, "Use of adeno-associated virus as a general transduction vector for mammalian cells," Curr. Top. Micro. Immunol. (1992) 158:97-129.
Naldini et al.,"In Vivo Gene Delivery and Stable Transduction of Nondividing Cells by a Lentiviral Vector," Science (1996) vol. 272, No. 5259, pp. 263-267.
Nambiar et al.,"CRISPR-based genome editing through the lens of DNA repair," Molecular Cell (2022) vol. 82, No. 2, pp. 348-388.
Nami et al.,"Strategies for In Vivo Genome Editing in Nondividing Cells," Trends Biotechnol (2018) vol. 36, No. 8, pp. 770-786.
Narayanavari et al., "Sleeping Beauty transposition: from biology to applications," Crit Rev Biochem Mol Biol (2017) 52(1):18-44.
Nelson et al.,"Engineering Delivery Vehicles for Genome Editing," Annu Rev Chem Biomol (2015) vol. 7, No. 1, pp. 44952.
Newby et al.,"Base editing of haematopoietic stem cells rescues sickle cell disease in mice," Nature (2021) vol. 595, No. 7866, pp. 295-302.
Newby et al.,"In vivo somatic cell base editing and prime editing," Mol Ther (Sep. 10, 2021) vol. 29, No. 11, pp. 3107-3124.
Nichuguti et al., "Both the Exact Target Site Sequence and a Long Poly(A) Tail Are Required for Precise Insertion of the 18S Ribosomal DNA-Specific Non-Long Terminal Repeat Retrotransposon R7Ag," Molecular and Cellular Biology (2016) vol. 36, No. 10, pp. 1494-1508.
Nicoud et al., "Development of photoreceptor-specific promoters and their utility to investigate EIAV lentiviral vector mediated gene transfer to photoreceptors," J. Gene Med. (2007) 9(12):1015-1023.
Nishimasu et al., "Crystal structure of Cas9 in complex with guide RNA and target DNA," Cell (2014) 156: P935-949.
Nishimasu et al.,"Engineered CRISPR-Cas9 nuclease with expanded targeting space," Science (2018) vol. 361, No. 6408, pp. 1259-1262.
Niu et al., "Engineering variants of the I-SceI homing endonuclease with strand-specific and site-specific DNA-nicking activity," J Mol Biol (2008) 382(1):188-202.
Nott et al., "A quantitative analysis of intron effects on mammalian gene expression," RNA (2003) 9(5):607-617.
Nott et al., "Splicing enhances translation in mammalian cells: an additional function of the exon junction complex," Genes & Development (2004) 18:210-222.
Nowak et al.,"Structural analysis of monomeric retroviral reverse transcriptase in complex with an RNA/DNA hybrid," Nucleic Acids Res (2013) vol. 41, No. 6, pp. 3874-3887.

Nunez et al.,"Cas1-Cas2 complex formation mediates spacer acquisition during CRISPR-Cas adaptive immunity," Nat Struct Mol Biol (2014) vol. 21, No. 6, pp. 528-534.
Oberdick et al., "A promoter that drives transgene expression in cerebellar Purkinje and retinal bipolar neurons," Science (1990) 248:223-226.
Oh et al., "Expression of transgenes in midbrain dopamine neurons using the tyrosine hydroxylase promoter," Gene Ther (2009) 16(3):437-440.
Oh et al.,"Expansion of the prime editing modality with Cas9 from Francisella novicida," bioRxiv (2021) Article 445577.
Okano et al.,"Accurate fidelity analysis of the reverse transcriptase by a modified next-generation sequencing," Enzyme Microb Tech (2018) vol. 115, No. , pp. 81-85.
Osanai et al., "Essential Motifs in the 3' Untranslated Region Required for Retrotransposition and the Precise Start of Reverse Transcription in Non-Long-Terminal-Repeat Retrotransposon SART1," Molecular and Cellular Biology (2004) vol. 24, No. 18, pp. 7902-7913.
Oscorbin et al.,"M-MuLV reverse transcriptase: Selected properties and improved mutants," Computational and Structural Biotechnology Journal (2021) vol. 19, No. , pp. 6315-6327.
Oscorbin et al.,"The attachment of a DNA-binding Sso7d-like protein improves processivity and resistance to inhibitors of M-MuLV reverse transcriptase," Febs Lett (2020) vol. 594, No. 24, pp. 4338-4356.
Ostertag et al., "Twin Priming—A Proposed Mechanism for the Creation of Inversions in L1 Retrotransposition," Genome Research (2001) vol. 11, pp. 2059-2065.
Ostertag et al.,"Biology of Mammalian L1 Retrotransposons," Annu Rev Genet (2001) vol. 35, No. 1, pp. 501-538.
Ouyang et al.,"RNA transcripts stimulate homologous recombination by forming DR-loops," Nature (May 12, 2021) vol. 594, No. 7862, pp. 283-288.
Pabo et al., "Design and selection of novel Cys2His2 zinc finger proteins," Ann. Rev. Biochem. (2001) 70:313-340.
Pajvani et al., "Fat apoptosis through targeted activation of caspase 8: a new mouse model of inducible and reversible lipoatrophy," Nat. Med. (2005)11(7):797-803.
Pardi et al.,"Synthetic Messenger RNA and Cell Metabolism Modulation, Methods and Protocols," Methods Mol Biology (2012) vol. 969, No. , pp. 29-42.
Park et al.,"MSH2 and MSH6 as size dependent cellular determinants for prime editing in human embryonic stem cells," bioRxiv (2022) vol. No. , pp. 2022.08.17.504216.
Park et al.,"Targeted mutagenesis in mouse cells and embryos using an enhanced prime editor," Genome Biol (Jun. 3, 2021) vol. 22, No. 1, pp. 170.
Parks et al. "A helper-dependent system for adenovirus vector production helps define a lower limit for efficient DNA packaging" J Virol (1997) 71(4): 3293-3298.
Parmacek et al., "A novel myogenic regulatory circuit controls slow/cardiac troponin C gene transcription in skeletal muscle," Mol. Cell. Biol. (1994) 14:1870-1885.
Liu et al. "CMV enhancer/human PDGF-beta promoter for neuron-specific transgene expression," Gene Therapy (2004) 11:52-60.
Liu et al.,"A split prime editor with untethered reverse transcriptase and circular RNA template," Nature Biotechnology (2022) vol. 40, No. 9, pp. 1388-1393.
Liu et al.,"Efficient generation of mouse models with the prime editing system," Cell Discov (2020) vol. 6, No. 1, pp. 27.
Liu et al.,"Enhancing prime editing by Csy4-mediated processing of pegRNA," Cell Res (Jun. 8, 2021) vol. 31, No. 10, pp. 1134-1136.
Liu et al.,"Flap Endonuclease 1: A Central Component of DNA Metabolism," Annu Rev Biochem (2004) vol. 73, No. 1, pp. 589-615.
Liu et al.,"Improved prime editors enable pathogenic allele correction and cancer modelling in adult mice," Nature Communications (2021) vol. 12, No. 1, pp. 2121.
Liu et al.,"Synthetic chimeric nucleases function for efficient genome editing," Nat Commun (2019) vol. 10, No. 1, pp. 5524.

(56) References Cited

OTHER PUBLICATIONS

Liu et al.,"Targeted genome editing with a DNA-dependent DNA polymerase and exogenous DNA-containing templates," Nature Biotechnology (2023) vol. No. , pp. 1-7.
Liu et al.,"The CRISPR-Cas toolbox and gene editing technologies," Molecular Cell (2022) vol. 82, No. 2, pp. 333-347.
Llewellyn et al., "Orderly recruitment of motor units under optical control in vivo," Nat. Med. (2010) 16(10):1161-1166.
Lopez et al.,"Improved architectures for flexible DNA production using retrons across kingdoms of life," (Mar. 26, 2021) vol. No. , pp.
Lopez et al.,"Precise genome editing across kingdoms of life using retron-derived DNA," Nature Chemical Biology (2022) vol. 18, No. 2, pp. 199-206.
Lu and Cullen, "Analysis of the stimulatory effect of splicing on mRNA production and utilization in mammalian cells," RNA (2003) 9:618-630.
Lu et al., "CDD/SPARCLE: the conserved domain database in 2020," Nucleic Acids Res (2020) 48:D265-268.
Lu et al., "Development of therapeutic antibodies for the treatment of diseases," J Biomed Sci (2020) 27, Article 1, 30 pages.
Luan et al.,"RNA Template Requirements for Target DNA-Primed Reverse Transcription by the R2 Retrotransposable Element," Mol Cell Biol (1995) vol. 15, No. 7, pp. 3882-3891.
Ma et al.,"Enhancing site-specific DNA integration by a Cas9 nuclease fused with a DNA donor-binding domain," Nucleic Acids Res (2020) vol. 48, No. 18, pp. gkaa779-.
MacKay et al., "The therapeutic landscape for cells engineered with chimeric antigen receptors," Nat Biotechnol (2020) 38:233-244.
Mahbub et al., "Globular domain structure and function of restriction-like-endonuclease LINEs-similarities to eukaryotic splicing factor Prp8," Mobile DNA (2017) vol. 8, Article 16, 15 pages.
Maita et al., "Crystal Structure of the Endonuclease Domain Encoded by the Telomere-specific Long Interspersed Nuclear Element, TRAS1," Journal of Biological Chemistry (2004) vol. 279, No. 39, pp. 41607-41076.
Maji, B. et al. A high-throughput platform to identify small molecule inhibitors of CRISPR-Cas9, Cell (2019) 177 (4):1067-1079.
Makarova et al.,"Evolutionary Classification of CRISPR-Cas Systems," Chapter 2 in CRISPR: Biology and Applications, First Edition (2022) Edited by Barrangou et al., pp. 13-38.
Makarova et al.,"Evolutionary classification of CRISPR-Cas systems: a burst of class 2 and derived variants," Nat Rev Microbiol (2020) vol. 18, No. 2, pp. 67-83.
Malik et al.,"Ribonuclease H evolution in retrotransposable elements," Cytogenet Genome Res (2005) vol. 110, No. 44930, pp. 392-401.
Mannironi et al., "H2A.X. a histone isoprotein with a conserved C-terminal sequence, is encoded by a novel mRNA with both DNA replication type and polyA 3' processing signals," Nucleic Acid Research (1989) 17:9113-9126.
Maresca et al.,"Obligate Ligation-Gated Recombination (ObLiGaRe): Custom-designed nuclease-mediated targeted integration through nonhomologous end joining," Genome Res (2013) vol. 23, No. 3, pp. 539-546.
Mason et al.. "Regulation of leptin promoter function by Sp1, C/EBP, and a novel factor," Endocrinol (1998) 139(3):1013-22.
Mastroianni et al.,"Group II Intron-Based Gene Targeting Reactions in Eukaryotes," Plos One (2008) vol. 3, No. 9, pp. e3121.
Matsuura et al.,"A bacterial group II intron encoding reverse transcriptase, maturase, and DNA endonuclease activities: Biochemical demonstration of maturase activity and insertion of new genetic information within the intron," Genes & Development (1997) vol. 11, pp. 2910-2924.
Mayford et al., "The 3'-untranslated region of CaMKII alpha is a cis-acting signal for the localization and translation of mRNA in dendrites," Proc. Natl. Acad. Sci. USA (1996) 93(23):13250-13255.
Mazina et al.,"Rad52 Inverse Strand Exchange Drives RNA-Templated DNA Double-Strand Break Repair," Mol Cell (2017) vol. 67, No. 1, pp. 19-29.e3.
McConnell Smith et al., "Generation of a nicking enzyme that stimulates site-specific gene conversion from the I-Anil LAGLIDADG homing endonuclease," PNAS (2009) 106(13):5099-104.
McKinnon et al.,"Flow Cytometry: An Overview," Curr Protoc Immunol (2018) vol. 120, No. 1, pp. 5.1.1-5.1.11.
Meaker et al.,"Advances in engineering CRISPR-Cas9 as a molecular Swiss Army knife," Synthetic Biology (2020) vol. 5, No. 1, pp. ysaa021.
Meers et al.,"DNA repair by RNA: Templated, or not templated, that is the question," Dna Repair (2016) vol. 44, No. , pp. 17-21.
Menéndez-Arias et al., "Viral reverse transcriptases," Virus Res (2017) 234:153-176.
Meyer (Ed.), Therapeutic Protein Drug Products: Practical Approaches to formulation in the Laboratory, Manufacturing, and the Clinic, Woodhead Publishing Series (2012).
Miller et al., "Design of retrovirus vectors for transfer and expression of the human beta-globin gene," J Virol (1988) 62:4337-4345.
Miller et al.,"A Tale nuclease architecture for efficient genome editing," Nat Biotechnol (2011) vol. 29, No. 2, pp. 143-148.
Miller et al.,"Continuous evolution of SpCas9 variants compatible with non-G PAMs," Nat Biotechnol (2020) vol. 38, No. 4, pp. 471-481..
Millevoi et al., "A physical and functional link between splicing factors promotes pre-mRNA 3' end processing," Nucleic Acid Research (2009) 37: 4672-4683.
Mills et al., "Which transposable elements are active in the human genome," Trends in Genetics (2007) vol. 23, No. 4, pp. 183-191.
Minczuk et al., "Development of a single-chain, quasi-dimeric zinc-finger nuclease for the selective degradation of mutated human mitochondrial DNA," Nucleic Acids Res (2008) 36(12):3926-3938.
Mir et al., "Heavily and fully modified RNAs guide efficient SpyCas9-mediated genome editing," Nat Commun (2018) 9(1):2641.
Mir et al.,"Type II-C CRISPR-Cas9 Biology, Mechanism, and Application," Acs Chem Biol (2018) vol. 13, No. 2, pp. 357-365.
Mita et al., "Line-1 protein localization and functional dynamics during the cell cycle," eLife (2018) vol. 7, Article e30058, 35 pages.
Mita et al.,"BRCA1 and S phase DNA repair pathways restrict Line-1 retrotransposition in human cells," Nat Struct Mol Biol (2020) vol. 27, No. 2, pp. 179-191.
Mitchell et al., "InterPro in 2019: improving coverage, classification and access to protein sequence annotations," Nucleic Acids Res (2019) 47:D351-360.
Mitchell et al.,"Retroviral DNA Integration: ASLV, HIV, and MLV Show Distinct Target Site Preferences," Plos Biol (2004) vol. 2, No. 8, pp. e234.
Miyagawa et al., "Identification of cis- and trans-acting factors involved in the localization of MALAT-1 noncoding RNA to nuclear speckles," RNA (2012) 18:738-751.
Gasiunas et al.,"A catalogue of biochemically diverse CRISPR-Cas9 orthologs," Nat Commun (2020) vol. 11, No. 1, pp. 5512.
Gaudelli et al.,"Programmable base editing of A:T to G:C in genomic DNA without DNA cleavage.," Nature (2017) vol. 551, No. 7681, pp. 464-471.
George et al., "Analysis of the 5' Junctions of R2 Insertions With the 28S Gene-Implications for Non-LTR Retrotransposition," Genetics (1996) vol. 142, pp. 853-863.
George et al.,"Efficient and error-free correction of sickle mutation in human erythroid cells using prime editor-2," Frontiers in Genome Editing (2022) vol. 4, No. , pp. 1085111.
Geurts et al.,"Evaluating CRISPR-based prime editing for cancer modeling and CFTR repair in organoids," Life Science Alliance (2021) vol. 4, No. 10, pp. e202000940.
Giannoukos et al.,"UDiTaS(TM), a genome editing detection method for indels and genome rearrangements," Bmc Genomics (2018) vol. 19, No. 1, pp. 212.
Gilbert et al.,"Multiple Fates of L1 Retrotransposition Intermediates in Cultured Human Cells," Mol Cell Biol (2005) vol. 25, No. 17, pp. 7780-7795.
Gillmore et al.,"CRISPR-Cas9 In Vivo Gene Editing for Transthyretin Amyloidosis," New Engl J Med (Jun. 26, 2021) vol. 385, No. 6, pp. 493-502.

(56) References Cited

OTHER PUBLICATIONS

Ginn et al., "Efficient in vivo editing of OTC-deficient patient-derived primary human hepatocytes," JHEP Reports (2019) 2(1):100065, 12 pages.
Gladyshev and Arkhipova, "Rotifer rDNA-specific R9 retrotransposable elements generate an exceptionally long target site duplication upon insertion," Gene (2009) 448(2):145-150.
Gonzalez-Delgado et al., "Prokaryotic reverse transcriptases: from retroelements to specialized defense systems," Fems Microbiol Rev (May 13, 2021) vol. 45, No. 6, pp. fuab025.
Goodier et al., "Restricting retrotransposons: a review," Mobile Dna-uk (2016) vol. 7, No. 1, pp. 16.
Govindaraju et al., "Endonuclease domain of non-LTR retrotransposons: loss-of-function mutants and modeling of the R2Bm endonuclease," Nucleic Acids Researh (2016) vol. 44, No. 7, pp. 3276-3287.
Grimm et al., Novel tools for production and purification of recombinant adenoassociated virus vectors, Hum Gene Ther (1998) 9(18):2745-2760. doi: 10.1089/hum.1998.9.18-2745.
Grindley et al., "Mechanisms of Site-Specific Recombination*," Annu Rev Biochem (2006) vol. 75, No. 1, pp. 567-605.
Gu et al., "Substitution of Asp114 or Arg116 in the Fingers Domain of Moloney Murine Leukemia Virus Reverse Transcriptase Affects Interactions with the Template-primer Resulting in Decreased Processivity," J Mol Biol (2001) vol. 305, No. 2, pp. 341-359.
Guha and Edgell, "Applications of Alternative Nucleases in the Age of CRISPR/Cas9," Int J Mol Sci (2017) 18(22):2565.
Guynet et al., "Resetting the Site: Redirecting Integration of an Insertion Sequence in a Predictable Way," Mol Cell (2009) vol. 34, No. 5, pp. 612-619.
Ha et al., "Exosomes as therapeutic drug carriers and delivery vehicles across biological membranes: current perspectives and future challenges," Acta Pharmaceutica Sinica B (2016) vol. 6, Issue 4, pp. 287-296.
Haack et al., "Cryo-EM Structures of a Group II Intron Reverse Splicing into DNA," Cell (2019) vol. 178, pp. 612-623.
Halperin et al., "CRISPR-guided DNA polymerases enable diversification of all nucleotides in a tunable window," Nature (2018) vol. 560, No. 7717, pp. 248-252.
Hamilton et al., "Biotechnology: Overcoming biological barriers to nucleic acid delivery using lipid nanoparticles," PLOS Biology (2023) vol. 21, No. 4, pp. e3002105.
Han et al., "Circular retrotransposition products generated by a Line retrotransposon," Nucleic Acids Research (2012) vol. 40, No. 21, pp. 10866-10877.
Han, "Non-long terminal repeat (non-LTR) retrotransposons: mechanisms, recent developments, and unanswered questions," Mobile Dna-uk (2010) vol. 1, No. 1, pp. 15-15.
Hansal et al., "Cutting Edge: Induction of antigen-specific hyporesponsiveness by transplantation of hemopoietic cells containing an MHC class I transgene regulated by a lymphocyte-specific promoter," J. Immunol. (1998) 161:1063-1068.
Harris et al., "Regulation of histone mRNA in the unperturbed cell cycle: evidence suggesting control at two posttranscriptional steps," Molecular Cellular Biology (1991) 11: 2416-2424.
Harrison et al., "CFTR RNA- and DNA-based therapies," Current Opinion in Pharmacology (2022) vol. 65, No. , pp. 102247.
Hashimoto et al., "Crystal structure of DNA polymerase from hyperthermophilic archaeon *Pyrococcus kodakaraensis* KOD111Edited by R. Huber," J Mol Biol (2001) vol. 306, No. 3, pp. 469-477.
Hausl et al., "Hyperactive sleeping beauty transposase enables persistent phenotypic correction in mice and a canine model for hemophilia B," Mol Ther (2010) 18(11):1896-906.
He and Pu, "Genome-wide location analysis by pull down of in vivo biotinylated transcription factors," Curr. Protoc Mol Biol (2010) Chapter 21, Unit 21.20., 18 pages.
Hendel et al., "Chemically modified guide RNAs enhance CRISPR-Cas genome editing in human primary cells," Nature Biotechnol. (2015) 33(9): 985-989.
Hendel et al., "Directed evolution in mammalian cells," Nat Methods (Apr. 7, 2021) vol. 18, No. 4, pp. 346-357.

Hermonat & Muzyczka, "Use of adeno-associated virus as a mammalian DNA cloning vector: transduction of neomycin resistance into mammalian tissue culture cells," PNAS (1984) 81:6466-6470.
Hernandez et al., "B2 and ALU retrotransposons are self-cleaving ribozymes whose activity is enhanced by EZH2," PNAS (2020) 117(1):415-425.
Herrera-Barrera et al., "Lipid Nanoparticle-Enabled Intracellular Delivery of Prime Editors," The AAPS Journal (2023) vol. 25, No. 4, pp. 65.
Herschhorn et al., "Retroviral reverse transcriptases," Cellular and Molecular Life Sciences (2010) vol. 67, pp. 2717-2747.
Higashimoto et al., "The woodchuck hepatitis virus post-transcriptional regulatory element reduces readthrough transcription from retroviral vectors," Gene Ther (2007) vol. 14, No. 17, pp. 1298-1304.
Hille et al., "The Biology of CRISPR-Cas: Backward and Forward," Cell (2018) vol. 172, No. 6, pp. 1239-1259.
Hillert et al., "The Genetic Landscape and Epidemiology of Phenylketonuria," The American Journal of Human Genetics (2020) vol. 107, No. 2, pp. 234-250.
Hodge et al., "Wide Awake and Ready to Move: 20 Years of Non-Viral Therapeutic Genome Engineering with the Sleeping Beauty Transposon System," Hum Gene Ther (2017) 28(10):842-855.
Hou et al., "DeepSF: deep convolutional neural network for mapping protein sequences to folds," Bioinformatics (2018) vol. 34, No. 8, pp. 1295-1303.
Hrecka et al., "Vpx relieves inhibition of HIV-1 infection of macrophages mediated by the SAMHD1 protein," Nature (2011) vol. 474, No. 7353, pp. 658-661.
Hsieh et al., "The Devil is in the details for DNA mismatch repair," Proc National Acad Sci (2017) vol. 114, No. 14, pp. 3552-3554.
Hsu et al., "PrimeDesign software for rapid and simplified design of prime editing guide RNAs," Nature Communications (2021) vol. 12, No. 1, pp. 1034.
Hu et al., "Evolved Cas9 variants with broad PAM compatibility and high DNA specificity," Nature (2018) vol. 556, No. 7699, pp. 57-63.
Huang et al., "Precision genome editing using cytosine and adenine base editors in mammalian cells," Nat Protoc (Jan. 18, 2021) vol. 16, No. 2, pp. 1089-1128.
Hunter et al., "Targeting gene expression to specific cardiovascular cell types in transgenic mice," Hypertension (1993) 22:608-617.
Hussman et al., Mapping the Genetic Langscape of DNA Double-strand Break Repair) bioRxiv (2021) 55 pages.
Hwang et al., "PE-Designer and PE-Analyzer: web-based design and analysis tools for CRISPR prime editing," Nucleic Acids Res (Jul. 2, 2021) vol. 49, No. W1, pp. gkab319-.
Ilina et al., "Retroviral RNase H: Structure, mechanism, and inhibition," The Enzymes (2021) vol. 50, No. , pp. 227-247.
U.S. Appl. No. 18/355,017, filed Jul. 19, 2023, Flagship Pioneering Innovations VI, LLC.
U.S. Appl. No. 17/929,455, filed Sep. 2, 2022, Flagship Pioneering Innovations VI, LLC.
U.S. Appl. No. 18/467,392, filed Sep. 14, 2023, Flagship Pioneering Innovations VI, LLC.
U.S. Appl. No. 18/467,428, filed Sep. 14, 2023, Flagship Pioneering Innovations VI, LLC.
U.S. Appl. No. 18/278,939, filed Aug. 25, 2023, Flagship Pioneering Innovations VI, LLC.
U.S. Appl. No. 18/282,644, filed Sep. 18, 2023, Flagship Pioneering Innovations VI, LLC.
U.S. Appl. No. 18/280,749, filed Sep. 7, 2023, Flagship Pioneering Innovations VI, LLC.
U.S. Appl. No. 18/563,127, filed Nov. 21, 2023, Flagship Pioneering Innovations VI, LLC.
U.S. Appl. No. 18/447,515, filed Aug. 10, 2023, Flagship Pioneering Innovations VI, LLC.
U.S. Appl. No. 18/447,536, filed Aug. 10, 2023, Flagship Pioneering Innovations VI, LLC.
U.S. Appl. No. 18/447,681, filed Aug. 10, 2023, Flagship Pioneering Innovations VI, LLC.
U.S. Appl. No. 18/469,344, filed Sep. 18, 2023, Flagship Pioneering Innovations VI, LLC.

(56) References Cited

OTHER PUBLICATIONS

U.S. Appl. No. 18/495,276, filed Oct. 26, 2023, Flagship Pioneering Innovations VI, LLC.
U.S. Appl. No. 18/470,687, filed Sep. 20, 2023, Flagship Pioneering Innovations VI, LLC.
Tratschin et al., "Adeno-associated virus vector for high-frequency integration, expression, and rescue of genes in mammalian cells," Mol. Cell. Biol. (1985) 5:3251-3260.
Trevino et al.,"Chapter Eight Genome Editing Using Cas9 Nickases," Methods Enzymol (2014) vol. 546, No. , pp. 161-174.
Truong et al., "Retrohoming of a Mobile Group II Intron in Human Cells Suggests How Eukaryotes Limit Group II Intron Proliferation," PLoS Genetics (2015) vol. 11, No. 8, Article e1005422, 35 pages.
Truong et al.,"Current state of RNA delivery using lipid nanoparticles to extrahepatic tissues: A review towards clinical translation," International Journal of Biological Macromolecules (2023) vol. 242, No. Pt 4, pp. 125185.
Tsai et al.,"Circle-seq: a highly sensitive in vitro screen for genome-wide CRISPR-Cas9 nuclease off-targets," Nat Methods (2017) vol. 14, No. 6, pp. 607-614.
Tsai et al.,"Defining and improving the genome-wide specificities of CRISPR-Cas9 nucleases," Nat Rev Genet (2016) vol. 17, No. 5, pp. 300-312.
Tsai et al.,"Guide-seq enables genome-wide profiling of off-target cleavage by CRISPR-Cas nucleases," Nat Biotechnol (2015) vol. 33, No. 2, pp. 187-197.
Tuerk and Gold, "Systematic evolution of ligands by exponential enrichment: RNA ligands to bacteriophage T4 DNA polymerase," Science (1990) 249(4968):505-510.
Uchida et al., "Development of a forward-oriented therapeutic lentiviral vector for hemoglobin disorders," Nat Commun (2019) vol. 10, Article 4479, 14 pages.
UniProt Consortium, "UniProt: UniProt: a worldwide hub of protein knowledge," Nucleic Acids Res (2019) 47: D506-D515.
Usmani et al., "THPdb: Database of FDA-approved peptide and protein therapeutics," PLoS One (2017) 12(7):e0181748, 12 pages.
Ustyantsev et al., "Convergence of retrotransposons in oomycetes and plants," Mobile DNA (2017) vol. 8, Article 4, 11 pages.
Valencia et al., "Splicing promotes rapid and efficient mRNA export in mammalian cells," PNAS (2008) 105:3386-3391.
Van Spronsen et al.,"Phenylketonuria," Nature Reviews Disease Primers (2021) vol. 7, No. 1, pp. 36.
Vashishtha et al.,"Different Divalent Cations Alter the Kinetics and Fidelity of DNA Polymerases*," J Biol Chem (2016) vol. 291, No. 40, pp. 20869-20875.
Wada et al.,"Precision genome editing in plants: state-of-the-art in CRISPR/Cas9-based genome engineering," BMC Plant Biol (2020) vol. 20, No. 1, pp. 234.
Wagstaff et al., "Molecular reconstruction of extinct Line-1 elements and their interaction with nonautonomous elements," Molecular Biology and Evolution (2013) 30(1): 88-99.
Wain-Hobson et al., Chapter 13 "Retrovirus Evolution" in Origin and Evolution of Viruses (Second Edition), Domingo et al., Eds. (2008) Elsevier Ltd., pp. 259-277.
Wallace et al., "L1 mobile element expression causes multiple types of toxicity," Gene (2008) vol. 419, pp. 75-81.
Walton et al.,"Unconstrained genome targeting with near-PAMless engineered CRISPR-Cas9 variants," Science (2020) vol. 368, No. 6488, pp. 290-296.
Wang et al., "Comparative Study of Liver Gene Transfer With AAV Vectors Based on Natural and Engineered AAV Capsids," Mol. Ther. (2015) 23:1877-1887.
Wang et al., "High-level protein production in erythroid cells derived from in vivo transduced hematopoietic stem cells," Blood Adv (2019) 3(19):2883-2894.
Wang et al., "Systematic evaluation of AAV vectors for liver directed gene transfer in murine models," Mol. Ther. (2010) 18:118-125.
Wang et al.,"A novel strategy to engineer DNA polymerases for enhanced processivity and improved performance in vitro," Nucleic acids research 32.3 (2004): 1197-1207.
Wang et al.,"Microbial single-strand annealing proteins enable CRISPR gene-editing tools with improved knock-in efficiencies and reduced off-target effects," Nucleic Acids Res (Apr. 6, 2021) vol. 49, No. 6, pp. e36-e36.
Wang et al.,"Rare variant contribution to human disease in 281,104 UK Biobank exomes," Nature (Aug. 10, 2021) vol. 597, No. 7877, pp. 527-532.
Webber et al.,"Highly efficient multiplex human T cell engineering without double-strand breaks using Cas9 base editors," Nat Commun (2019) vol. 10, No. 1, pp. 5222.
Wells et al.,"A Field Guide to Eukaryotic Transposable Elements," Annu Rev Genet (2020) vol. 54, No. 1, pp. 44949.
Wesselhoeft et al., "Engineering circular RNA for potent and stable translation in eukaryotic cells," Nature Communications (2018) 9(1):2629.
Wesselhoeft et al.,"RNA Circularization Diminishes Immunogenicity and Can Extend Translation Duration In-Vivo," Mol Cell (2019) vol. 74, No. 3, pp. 508-520.e4.
West et al., "Gene expression in adeno-associated virus vectors: the effects of chimeric mRNA structure, helper virus, and adenovirus VA1 RNA," Virology (1987) 160:38-47.
Whifield et al., "Stem-loop binding protein, the protein that binds the 3' end of histone mRNA, is cell cycle regulated by both translational and posttranslational mechanisms," Molecular Cellular Biology (2000) 20:4188-4198.
Wicker et al., "A unified classification system for eukaryotic transposable elements," Nature Reviews Genetics (2007) vol. 8, pp. 973-982.
Wolff et al.,"Prime editing in hematopoietic stem cells—From ex vivo to in vivo CRISPR-based treatment of blood disorders," Frontiers in Genome Editing (2023) vol. 5, No. , pp. 1148650.
Wolfs et al., "Biasing genome-editing events toward precise length deletions with an RNA-guided TevCas9 dual nuclease," PNAS (2016) 113(52):14988-14993.
Wolfs et al., "MegaTevs: single-chain dual nucleases for efficient gene disruption," Nucleic Acids Res (2014) 42(13):8816-29.
Wood et al., "Wood et al., J. Biol. Chem.289(21); 14512-9 (2014)," J. Biol. Chem. (2014) 289(21):14512-14519.
Wu et al.,"Highly efficient therapeutic gene editing of human hematopoietic stem cells," Nature Medicine (2019) vol. 25, No. 5, pp. 776-783.
Wurth et al., "Hypermethylated-capped selenoprotein mRNAs in mammals," Nucleic Acid Res (2014) 42: 8663-8677.
Xiong et al.,"Functional expression of a sequence-specific endonuclease encoded by the retrotransposon R2Bm," Cell (1988) vol. 55, No. 2, pp. 235-246.
Xiong et al.,"Origin and evolution of retroelements based upon their reverse transcriptase sequences.," Embo J (1990) vol. 9, No. 10, pp. 3353-3362.
Xu et al.,"Engineered miniature CRISPR-Cas system for mammalian genome regulation and editing," Mol Cell (Oct. 21, 2021) vol. 81, No. 20, pp. 4333-4345.e4.
Yan et al., "Functionally diverse type V CRISPR-Cas systems" Science (2019) vol. 363, No. 6422, pp. 88-91.
Yang et al., "Identification and characterization of nuclear and nucleolar localization signals in 58-kDa microsphrule protein (MSP58)," Journal of Biomedical Science (2015) vol. 22, Article 33, 15 pages.
Yasukawa et al.,"Comparison of the Thermal Stabilities of Reverse Transcriptases from Avian Myeloblastosis Virus and Moloney Murine Leukaemia Virus," Journal of Biochemistry (2007) vol. 143, No. 2, pp. 261-268.
Yasukawa et al.,"Next-generation sequencing-based analysis of reverse transcriptase fidelity," Biochem Bioph Res Co (2017) vol. 492, No. 2, pp. 147-153.
Yin et al.,"Structure-guided chemical modification of guide RNA enables potent non-viral in vivo genome editing," Nat Biotechnol (2017) vol. 35, No. 12, pp. 1179-1187.

(56) References Cited

OTHER PUBLICATIONS

Yokoyama et al., "Photoreceptor-specific activity of the human interphotoreceptor retinoid-binding protein (IRBP) promoter in transgenic mice," Exp Eye Res. (1992) 55:225-233.

Young et al., "A short, highly active photoreceptor-specific enhancer/promoter region upstream of the human rhodopsin kinase gene," Invest. Ophthalmol. Vis. Sci. (2003) 44:4076-4085.

Yu et al., "Colonization of rice leaf blades by an African strain of Xanthomonas oryzae pv. oryzae depends on a new TAL effector that induces the rice nodulin-3 Os11N3 gene," Mol Plant Microbe Interact (2011) 24(9):1102-1113.

Bogdanove et al., "Two new complete genome sequences offer insight into host and tissue specificity of plant pathogenic Xanthomonas spp.," J Bacteriol (2011) 193(19):5450-5464.

Boissinot et al., "L1 (Line-1) Retrotransposon Evolution and Amplification in Recent Human History," Molecular Biology and Evolution 2000, 915-928.

Bothmer et al., "Characterization of the interplay between DNA repair and CRISPR/Cas9-induced DNA lesions at an endogenous locus," Nat Commun (2017) vol. 8, Article 13905, 12 pages.

Boundy et al., "Regulation of tyrosine hydroxylase promoter activity by chronic morphine in TH9.0-LacZ transgenic mice," J. Neurosci. (1998) 18(23): 9989-9995.

Breda et al., "In Vivo Modification of Hematopoietic Stem Cells By Targeted Lipid Nanoparticles Encapsulating mRNA," Blood (2022) vol. 140, No. Supplement 1, pp. 305-306.

Brooks et al., "Efficient in vivo prime editing corrects the most frequent phenylketonuria variant, associated with high unmet medical need," The American Journal of Human Genetics (2023) vol. 110, No. 12, pp. 2003-2014.

Brown et al., "A mammalian protein targeted by G1-arresting rapamycin-receptor complex," Nature (1994) 369 (6483):756-758.

Brown et al., "Formation of triple-helical structures by the 3'-end sequences of MALAT1 and MENBeta noncoding RNAs," PNAS (2012) vol. 109, pp. 19202-19207.

Bulcha et al., "Viral vector platforms within the gene therapy landscape," Signal Transduct Target Ther (Feb. 8, 2021) vol. 6, No. 1, pp. 53.

Burke et al., "Sequence relationship of retrotransposable elements R1 and R2 within and between divergent insect species," Molecular Biology and Evolution (1993) vol. 10, No. 1, pp. 163-185.

Burke et al., "The domain structure and retrotransposition mechanism of R2 elements are conserved throughout arthropods.," Mol Biol Evol (1999) vol. 16, No. 4, pp. 502-511.

Cameron et al., "Harnessing type I CRISPR-Cas systems for genome engineering in human cells," Nat Biotechnol (2019) vol. 37, No. 12, pp. 1471-1477.

Candales et al., "Database for bacterial group II introns," Nucleic Acids Research (2012) vol. 40, pp. D187-D190.

Carroll et al., "Genome Engineering with Targetable Nucleases," Biochemistry-us (2014) vol. 83, No. 1, pp. 409-439.

Casanova et al., "A CamKIIalpha iCre BAC allows brain-specific gene inactivation," Genesis (2001) 31(1):37-42.

Chaikind et al., "A programmable Cas9-serine recombinase fusion protein that operates on DNA sequences in mammalian cells," Nucleic Acids Res (2016) vol. 44, No. 20, pp. 9758-9770.

Chakrabarti, "Promoting adipose specificity: the adiponectin promoter," Endocrinol. (2010) 51(6):2408-2410.

Chan et al., "Crystal structure of a group II intron in the pre-catalytic state," Nature Structural & Molecular Biology (2012) vol. 19, No. 5, pp. 555-557.

Chandler et al., "Breaking and joining single-stranded DNA: the HUH endonuclease superfamily," Nat Rev Microbiol (2013) vol. 11, No. 8, pp. 525-538.

Chandramouly et al., "Pol? reverse transcribes RNA and promotes RNA-templated DNA repair," Sci Adv (Jun. 11, 2021) vol. 7, No. 24, pp. eabf1771.

Chang et al., "TAIL-seq: genome-wide determination of poly(A) tail length and 3' end modifications," Molecular Cell (2014) vol. 53, pp. 1044-1052.

Chatterjee et al., "An engineered ScCas9 with broad PAM range and high specificity and activity," Nat Biotechnol (2020) vol. 38, No. 10, pp. 1154-1158.

Chemello et al., "Precise correction of Duchenne muscular dystrophy exon deletion mutations by base and prime editing," Science Advances (2021) vol. 7, No. 18, pp. eabg4910.

Chen et al., "A lymphoproliferative abnormality associated with inappropriate expression of the Thy-1 antigen in transgenic mice," Cell (1987) 51:7-19.

Chen et al., "Analysis of a 762-bp proximal leptin promoter to drive and control regulation of transgene expression of growth hormone receptor in mice," Biochem. Biophys. Res. Comm. (1999) 262(1):187-192.

Chen et al., "CRISPR-Cas12a target binding unleashes indiscriminate single-stranded DNase activity," Science (2018) vol. 360(6387):436-439.

Chen et al., "Expression of rat bone sialoprotein promoter in transgenic mice," J. Bone Miner. Res. (1996) 11:654-664.

Chen et al., "Identification of an 11-kDa FKBP12-rapamycin-binding domain within the 289-kDa FKBP12-rapamycin-associated protein and characterization of a critical serine residue," Proc Natl Acad Sci USA. 1995; 92(11):4947-4951.

Chen et al., "Fusion Protein Linkers: Property, Design and Functionality," Adv Drug Deliv Rev (2013) 65(10):1357-1369.

Chen et al., "Prime editing for precise and highly versatile genome manipulation," Nature Reviews Genetics (2023) vol. 24, No. 3, pp. 161-177.

Chen et al., "Programmable C:G to G:C genome editing with CRISPR-Cas9-directed base excision repair proteins," Nat Commun (Mar. 2, 2021) vol. 12, No. 1, pp. 1384.

Cheng et al., "Selective organ targeting (SORT) nanoparticles for tissue-specific mRNA delivery and CRISPR-Cas gene editing," Nat Nanotechnol (2020) 15(4):313-320.

Chicaybam et al., "Chimeric Antigen Receptor T Cells, Development and Production," Methods Mol Biology (2019) vol. 2086, No. , pp. 131-137.

Choi et al., "Interplay between RNASEH2 and MOV10 controls Line-1 retrotransposition," Nucleic Acids Research (2018) doi: 10/1093/nar/gkx1312, 15 pages.

Choi et al., "Structure of the FKBP12-rapamycin complex interacting with the binding domain of human FRAP," Science (1996) 273(5272):239-242.

Choi et al., "Precise genomic deletions using paired prime editing," Biorxiv (Jan. 2, 2021) vol. No. , pp. 2020.12.30.424891.

Choo et al., "Advances in zinc finger engineering," Curr. Opin. Struct. Biol. (2000) 10:411-416.

Chow et al., "A web tool for the design of prime-editing guide RNAs," Nature Biomedical Engineering (2021) vol. 5, No. 2, pp. 190-194.

Christensen et al., "RNA from the 5' end of the R2 retrotransposon controls R2 protein binding to and cleavage of its DNA target site," Proceedings of the National Academy of Sciences (2006) vol. 103, No. 47, pp. 17602-17607.

Christensen et al., "Role of the Bombyx mori R2 element N-terminal domain in the target-primed reverse transcription (TPRT) reaction," Nucleic Acids Research (2005) vol. 33, No. 20, pp. 6461-6468.

Christensen et al., "R2 Target-Primed Reverse Transcription: Ordered Cleavage and Polymerization Steps by Protein Subunits Asymmetrically Bound to the Target DNA," Mol Cell Biol (2005) vol. 25, No. 15, pp. 6617-6628.

Chu et al., "Rationally Designed Base Editors for Precise Editing of the Sickle Cell Disease Mutation," The CRISPR Journal (2021) vol. 4, No. 2, pp. 169-177.

Clement et al., "CRISPResso2 provides accurate and rapid genome editing sequence analysis," Nature Biotechnology (2019) vol. 37, No. 3, pp. 224-226.

Coggins et al., "Enhanced enzyme kinetics of reverse transcriptase variants cloned from animals infected with SIVmac239 lacking viral protein X," J Biol Chem (2020) vol. 295, No. 50, pp. 16975-16986.

Cohen et al., "Prime editing promises to be a cut above CRISPR," Science (2019) vol. 366, No. 6464, pp. 406-406.

(56) References Cited

OTHER PUBLICATIONS

Collias et al.,"CRISPR technologies and the search for the PAM-free nuclease," Nat Commun (Jan. 22, 2021) vol. 12, No. 1, pp. 555.
Comb et al., "Proteins bound at adjacent DNA elements act synergistically to regulate human proenkephalin cAMP inducible transcription," EMBO J (1988) 17:3793-3805.
Cooney et al., "A Novel AAV-mediated Gene Delivery System Corrects CFTR Function in Pigs," Am J Respir Cell Mol Biol (2019) 61(6):747-754.
Cordaux et al., "The impact of retrotransposons on human genome evolution," Nature Reviews Genetics (2009) Nature Reviews vol. 10, pp. 691-703.
Cost et al., "Targeting of Human Retrotransposon Integration Is Directed by the Specificity of the L1 Endonuclease for Regions of Unusual DNA Structure," Biochemistry (1998) vol. 37, pp. 18081-18093.
Yu et al., "Receptor-targeted nanocarriers for therapeutic delivery to cancer," Mol Membr Biol (2010) 27:286-298.
Zeng et al.,"The initiation, propagation and dynamics of CRISPR-SpyCas9 R-loop complex," Nucleic Acids Res (2017) vol. 46, No. 1, pp. gkx1117-.
Zetsche et al., "Cpf1 is a single RNA-guided endonuclease of a class 2 CRISPR-Cas system," Cell (2015) 163:759-771.
Zhang et al., "A novel RNA motif mediates the strict nuclear localization of a long noncoding RNA," Molecular and Cellular Biology 34, 2318-2329 (2014).
Zhang et al., "Efficient construction of sequence-specific TAL effectors for modulating mammalian transcription," Nat Biotechnol (2011) 29(2):149-153.
Zhang et al., "Intron function in the nonsense-mediated decay of beta-globin mRNA: indications that pre-mRNA splicing in the nucleus can influence mRNA translation in the cytoplasm," RNA (1998) 4:801-815.
Zhang et al.,"Catalytic-state structure and engineering of *Streptococcus thermophilus* Cas9," Nature Catalysis (2020) vol. 3, No. 10, pp. 813-823.
Zhang et al.,"Expanding the Potential of Mammalian Genome Engineering via Targeted DNA Integration," Acs Synth Biol (Feb. 17, 2021) vol. 10, No. 3, pp. 429-446.
Zhang et al.,"Genome Editing with mRNA Encoding ZFN, TALEN, and Cas9," Mol Ther (2019) vol. 27, No. 4, pp. 735-746.
Zhang et al.,"Lipids and Lipid Derivatives for RNA Delivery," Chem Rev (Jul. 19, 2021) vol. 121, No. 20, pp. 12181-12277.
Zhao et al., "An ultraprocessive, accurate reverse transcriptase encoded by a metazoan group II intron," RNA (2018) 24: 183-195.
Zhao et al., "Crystal structures of a group II intron maturase reveal a missing link in spliceosome evolution," Nature Structural & Molecular Biology (2016) vol. 23, No. 6, pp. 558-567.
Zhao et al., "Targeted drug delivery via folate receptors," Expert Opin Drug Deliv (2008) 5:309-319.
Zhao et al.,"Bacterial Retrons Enable Precise Gene Editing in Human Cells," The CRISPR Journal (2022) vol. 5, No. 1, pp. 31-39.
Zhao et al.,"Glycosylase base editors enable C-to-A and C-to-G base changes," Nat Biotechnol (20200720) vol. 39, No. 1, pp. 35-40.
Zhao et al.,"High-Efficiency Transfection of Primary Human and Mouse T Lymphocytes Using RNA Electroporation," Mol Ther (2006) vol. 13, No. 1, pp. 151-159.
Zhao et al.,"Prime editing: advances and therapeutic applications," Trends in Biotechnology (2023) vol. 41, No. 8, pp. 1000-1012.
Zheng et al.,"A flexible split prime editor using truncated reverse transcriptase improves dual-AAV delivery in mouse liver," Molecular Therapy (2022) vol. 30, No. 3, pp. 1343-1351.
Zheng et al.,"Development of a flexible split prime editor using truncated reverse transcriptase," Biorxiv (Aug. 29, 2021) vol. No. , pp. 2021.08.26.457801.
Zheng et al.,"Template-jumping prime editing enables large insertion and exon rewriting in vivo," Nature Communications (2023) vol. 14, No. 1, pp. 3369.

Zhi et al.,"Dual-AAV delivering split prime editor system for in vivo genome editing," Mol Ther (Jul. 20, 2021) vol. No. , pp.
Zimmerly et al., "A Group II Intron RNA Is a Catalytic Component of a DNA Endonuclease Involved in Intron Mobility," Cell (1995) vol. 83, pp. 529-538.
Zimmerly et al., "An Unexplored Diversity of Reverse Transcriptases in Bacteria," Microbiology Spectrum (2015) vol. 3, No. 2, Article MDNA-0058-2014, 16 pages.
Zimmermann et al.,"A Completely Reimplemented MPI Bioinformatics Toolkit with a New HHpred Server at its Core," J Mol Biol (2018) vol. 430, No. 15, pp. 2237-2243.
Zingler et al.,"Analysis of 5' junctions of human LINE-1 and Alu retrotransposons suggests an alternative model for 5'-end attachment requiring microhomology-mediated end-joining," Genome Res (2005) vol. 15, No. 6, pp. 780-789.
Imburgio et al., Studies of promoter recognition and start site selection by T7 Rna polymerase using a comprehensive collection of promoter variants, Biochemistry (2000) 39(34):10419-10430.
International Search Report and Written Opinion issued in PCT/US2021/020948, mailed Oct. 7, 2021.
International Search Report and Written Opinion issued in PCT/US2022/076045, mailed Apr. 13, 2023, 23 pages.
Isalan et al., "A rapid, generally applicable method to engineer zinc fingers illustrated by targeting the HIV-1 promoter," Nature Biotechnol. (2001) 19:656-660.
Ishii et al., "Analysis of the Role of Homology Arms in Gene-Targeting Vectors in Human Cells," PLoS One (2014) 9:9: e108236, 9 pages.
Ivancevic et al., "LINEs between Species—Evolutionary Dynamics of LINE-1 Retrotransposons across the Eukaryotic Tree of Life," Genome Biology and Evolution (2016) vol. 8, No. 11, pp. 3301-3322.
Ivics et al., "Molecular Reconstruction of Sleeping Beauty, a Tc1-like Transposon from Fish, and Its Transposition in Human Cells," Cell 1997, vol. 91, pp. 501-510.
Jackson et al.,"The mechanism of eukaryotic translation initiation and principles of its regulation," Nat Rev Mol Cell Bio (2010) vol. 11, No. 2, pp. 113-127.
Jager et al., "A rapid protocol for construction and production of high-capacity adenoviral vectors," Nat Protoc (2009) 4(4):547-564.
Jamburuthugoda et al., "The Reverse Transcriptase Encoded by the Non-LTR Retrotransposon R2 Is as Error-Prone as That Encoded by HIV-1," J Mol Biol (2011) vol. 407, pp. 661-672.
Jang et al.,"Application of prime editing to the correction of mutations and phenotypes in adult mice with liver and eye diseases," Nature Biomedical Engineering (2022) vol. 6, No. 2, pp. 181-194.
Jayaraman et al., "Maximizing the potency of siRNA lipid nanoparticles for hepatic gene silencing in vivo," Angew Chem Int Ed Engl (2012) 51(34):8529-8533.
Jiang et al.,"Chemical modifications of adenine base editor mRNA and guide RNA expand its application scope," Nat Commun (2020) vol. 11, No. 1, pp. 1979.
Jiang et al.,"Programming large target genomic deletion and concurrent insertion via a prime editing-based method: PEDAR," Biorxiv (May 13, 2021) vol. No. , pp. 2021.05.12.443800.
Jiang et al.,"Structures of a CRISPR-Cas9 R-loop complex primed for DNA cleavage," Science (2016) vol. 351, No. 6275, pp. 867-871.
Jinek et al., "A Programmable Dual-RNA-Guided DNA Endonuclease in Adaptive Bacterial Immunity," Science (2012) vol. 337, pp. 816-821 and Supplementary Materials.
Johansson et al.,"A thermodynamic analysis of the sequence-specific binding of RNA by bacteriophage MS2 coat protein," Proc National Acad Sci (1998) vol. 95, No. 16, pp. 9244-9249.
Jozwiakowski et al.,"A Modified Family-B Archaeal DNA Polymerase with Reverse Transcriptase Activity," Chembiochem (2011) vol. 12, No. 1, pp. 35-37.
Jumper et al.,"Highly accurate protein structure prediction with AlphaFold," Nature (Jul. 15, 2021) vol. 596, No. 7873, pp. 583-589.
Jurka et al., "Sequence patterns indicate an enzymatic involvement in integration of mammalian retroposons," Proceedings of the National Academy of Sciences (1997) vol. 94, pp. 1872-1877.

(56) References Cited

OTHER PUBLICATIONS

Kaida et al., "U1 snRNP protects pre-mRNAs from premature cleavage and polyadenylation," Nature (2010) 468:664-668.
Kajikawa et al.,"A new mechanism to ensure integration during Line retrotransposition: A suggestion from analyses of the 5' extra nucleotides," Gene (2012) vol. 505, No. 2, pp. 345-351.
Kaneda et al., "Tissue-specific and high-level expression of the human tyrosine hydroxylase gene in transgenic mice," Neuron (1991) 6:583-594.
Kanter et al.,"Biologic and Clinical Efficacy of LentiGlobin for Sickle Cell Disease," New England Journal of Medicine (2021) vol. 386, No. 7, pp. 617-628.
Karst et al., "Enabling high-accuracy long-read amplicon sequences using unique molecular identifiers with Nanopore or PacBio sequencing," bioRxiv (2020) doi.org/10.1101/645903, 72 pages.
Karst et al.,"High-accuracy long-read amplicon sequences using unique molecular identifiers with Nanopore or PacBio sequencing," Nat Methods (Jan. 11, 2021) vol. 18, No. 2, pp. 165-169.
Kawashima et al., "A novel target-specific gene delivery system combining baculovirus and sequence-specific long interspersed nuclear elements," Virus Research (2007) vol. 127, pp. 49-60.
Kebriaei et al.,"Gene Therapy with the Sleeping Beauty Transposon System," Trends Genet (2017) vol. 33, No. 11, pp. 852-870.
Kelley et al.,"The Phyre2 web portal for protein modeling, prediction and analysis," Nat Protoc (2015) vol. 10, No. 6, pp. 845-858.
Kelly et al.,"Yeast tRNAPhe expressed in human cells can be selected by HIV-1 for use as a reverse transcription primer," Virology (2003) vol. 313, No. 2, pp. 354-363.
Kennedy et al.,"Protein-responsive ribozyme switches in eukaryotic cells," Nucleic Acids Res (2014) 42(19):12306-12321.
Keskin et al.,"Transcript RNA supports precise repair of its own DNA gene," Rna Biol (2015) vol. 13, No. 2, pp. 157-165.
Khalil et al.,"Lipid Nanoparticles for Cell-Specific in Vivo Targeted Delivery of Nucleic Acids," Biological Pharm Bulletin (2020) vol. 43, No. 4, pp. 584-595.
Kiani et al.,"Cas9 gRNA engineering for genome editing, activation and repression," Nat Methods (2015) vol. 12, No. 11, pp. 1051-1054.
Kiim et al.,"Predicting the efficiency of prime editing guide RNAs in human cells," Nature Biotechnology (2021) vol. 39, No. 2, pp. 198-206.
Kiledjian, "Eukaryotic RNA 5'-End NAD+ Capping and DeNADding," Trends in Cell Biology (2018) 28:454-464.
Kim et al., "A serum response factor-dependent transcriptional regulatory program identifies distinct smooth muscle cell sublineages," Mol. Cell. Biol. (1997) 17: 2266-2278.
Kim et al., "Antibody-mediated delivery of siRNAs for anti-HIV therapy," Methods Mol Biol. 2011 721:339-353.
Kim et al.,"Adenine base editing and prime editing of chemically derived hepatic progenitors rescue genetic liver disease," Cell Stem Cell (2021) vol. 28, No. 9, pp. 1614-1624.e5.
Kim et al.,"Chromatin structure and context-dependent sequence features control prime editing efficiency," bioRxiv (2023) vol. No. , pp. 2023.04.15.536944.
Kim et al.,"Digenome-seq: genome-wide profiling of CRISPR-Cas9 off-target effects in human cells," Nat Methods (2015) vol. 12, No. 3, pp. 237-243.
Kim et al.,"Ex vivo therapeutic base and prime editing using chemically derived hepatic progenitors in a mouse model of tyrosinemia type 1," bioRxiv (2020) vol. No. , pp. 2020.09.14.297275.
Kim et al.,"Increasing the genome-targeting scope and precision of base editing with engineered Cas9-cytidine deaminase fusions," Nat Biotechnol (2017) vol. 35, No. 4, pp. 371-376.
Kim et al.,"Unbiased investigation of specificities of prime editing systems in human cells," Nucleic Acids Res (2020) vol. 48, No. 18, pp. 10576-10589.
King et al.,"Correction of Airway Stem Cells: Genome Editing Approaches for the Treatment of Cystic Fibrosis," Human Gene Therapy (2020) vol. 31, No. 17-18, pp. 956-972.
Kita et al.,"Identification of the promoter region required for human adiponectin gene transcription: Association with CCAAT/enhancer binding protein-beta and tumor necrosis factor-alpha," Biochem. Biophys. Res. Comm. (2005) 331(2):484-490.
Kleinstiver et al., "Monomeric site-specific nucleases for genome editing," PNAS (2012) 109(21):8061-8066.
Kleinstiver et al.,"Engineered CRISPR-Cas9 nucleases with altered PAM specificities," Nature (2015) vol. 523, No. 7561, pp. 481-485.
Kleinstiver et al., "High-fidelity CRISPR-Cas9 nucleases with no detectable genome-wide off-target effects," Nature (2016) vol. 529, No. 7587, pp. 490-495.
Klompe et al., "Transposon-encoded CRISPR-Cas systems direct RNA-guided DNA integration," Nature (2019) vol. 571, No. 7764, pp. 219-225.
Craig et al., Editors, "Mobile DNA III," ASM Press (2015) pp. 1-1346.
Crossley et al.,"Effective therapies for sickle cell disease: are we there yet?," Trends in Genetics (2022) vol. 38, No. 12, pp. 1284-1298.
Dalwadi et al., "AAV integration in human hepatocytes," Mol Ther (Aug. 28, 2021) vol. 29, No. 10, pp. 2898-2909.
Davidson et al., "Emulsion based selection of T7 promoters of varying activity," Pac Symp Biocomput (2010) pp. 433-443.
Davidsson et al., "A systematic capsid evolution approach performed in vivo for the design of AAV vectors with tailored properties and tropism," Proc Natl Acad Sci USA (2019) 116(52):27053-27062.
Davis et al., "Homology-directed repair of DNA nicks via pathways distinct from canonical double-strand break repair," Proc National Acad Sci (2014) vol. 111, No. 10, pp. E924-E932.
Dever et al., "CRISPR/Cas9 ß-globin gene targeting in human haematopoietic stem cells," Nature (2016) vol. 539, No. 7629, pp. 384-389.
Dewannieux et al., "Role of poly(A) tail length in Alu retrotransposition," Genomics (2005) vol. 86, pp. 378-381.
Dewran Kocak et al.,"Increasing the specificity of CRISPR systems with engineered RNA secondary structures," Nat Biotechnol (2019) vol. 37, No. 6, pp. 657-666.
Doench et al., "Optimized sgRNA design to maximize activity and minimize off-target effects of CRISPR-Cas9," Nat Biotechnol (2016) vol. 34, No. 2, pp. 184-191.
Doman et al.,"Phage-assisted evolution and protein engineering yield compact, efficient prime editors," Cell (2023) vol. 186, No. 18, pp. 3983-4002.e26.
Doucet et al., "A 3' Poly(A) Tract Is Required for Line-1 Retrotransposition," Molecular Cell (2015) vol. 60, pp. 728-741.
Duncan et al., "An Adeno-Associated Viral Vector Capable of Penetrating the Mucus Barrier to Inhaled Gene Therapy," Mol Ther Methods Clin Dev (2018)9:296-304.
Egli et al.,"Re-Engineering RNA Molecules into Therapeutic Agents," Accounts Chem Res (2019) vol. 52, No. 4, pp. 1036-1047.
Eickbush et al., "Integration of Bombyx mori R2 Sequences into the 28S Ribosomal RNA Genes of *Drosophila melanogaster*," Molecular and Cellular Biology (2000) vol. 20, No. 1, pp. 213-223.
Eickbush et al., "Integration, Regulation, and Long-Term Stability of R2 Retrotransposons," Microbiology Spectrum (2015) vol. 3, No. 2, MDNA3-011, 20 pages.
Eickbush et al., "R2 and R2-R1 hybrid non-autonomous retrotransposons derived by internal deletions of full-length elements," Mobile DNA (2012) vol. 3, Article 10, 15 pages.
Eickbush et al., "R2 Retrotransposons Encode a Self-Cleaving Ribozyme for Processing from an rRNA Cotranscript," Molecular and Cellular Biology (2010) vol. 30, No. 13, pp. 3142-3150.
Eickbush et al., "The diversity of retrotransposons and the properties of their reverse transcriptases," Virus Res (2008) 134(1-2):221-234.
Elacqua et al., "NickSeq for genome-wide strand-specific identification of DNA single-strand break sites with single nucleotide resolution," bioRxiv (2019) doi.org/10.1101/867937, 27 pages.
Elhaway et al., "Genetic etiology and clinical challenges of phenylketonuria," Human Genomics (2022) vol. 16, No. 1, pp. 22.

(56) References Cited

OTHER PUBLICATIONS

Ellefson et al., "Synthetic evolutionary origin of a proofreading reverse transcriptase," Science (2016) vol. 352, No. 6293, pp. 1590-1593.
Ellington and Szostak, "In vitro selection of RNA molecules that bind specific ligands," Nature (1990) 346(6287):818-822.
Enyeart et al.,"Biotechnological applications of mobile group II introns and their reverse transcriptases: gene targeting, RNA-seq, and non-coding RNA analysis," Mobile Dna-uk (2014) vol. 5, No. 1, pp. 2.
Everette et al., "Ex vivo prime editing of patient haematopoietic stem cells rescues sickle-cell disease phenotypes after engraftment in mice," Nature Biomedical Engineering (2023) vol. 7, No. 5, pp. 616-628.
Eygeris et al., "Deconvoluting Lipid Nanoparticle Structure for Messenger RNA Delivery," Nano Lett (2020) vol. 20, pp. 4543-4549.
Fagerberg et al., "Analysis of the human tissue-specific expression by genome-wide integration of transcriptomics and antibody-based proteomics," Mol Cell Proteomics (2014) 13(2):397-406.
Feng et al.,"Enhancing prime editing efficiency and flexibility with tethered and split pegRNAs," Protein & Cell (2022) vol. 14, No. 4, pp. 304-308.
Feng et al.,"Precise targeted integration by a chimaeric transposase zinc-finger fusion protein," Nucleic Acids Res (2010) vol. 38, No. 4, pp. 1204-1216.
Ferreira Da Silva et al.,"Prime editing efficiency and fidelity are enhanced in the absence of mismatch repair," Nature Communications (2022) vol. 13, No. 1, pp. 760.
Filippo et al., "Characterization of the C-terminal DNA-binding/DNA Endonuclease Region of a Group II Intron-encoded Protein," J Mol Biol (2002) vol. 324, pp. 933-951.
Filippova et al.,"Guide RNA modification as a way to improve CRISPR/Cas9-based genome-editing systems," Biochimie (2019) vol. 167, No. , pp. 49-60.
Finn et al., "A Single Administration of CRISPR/Cas9 Lipid Nanoparticles Achieves Robust and Persistent In Vivo Genome Editing," Cell Rep (2018) 22(9):2227-2235.
Finn et al.,"InterPro in 2017—beyond protein family and domain annotations," Nucleic Acids Res (2017) vol. 45, No. D1, pp. D190-D199.
Finnegan, "Transposable elements—How non-LTR retrotransposons do it," Current Biology (1997) vol. 7, pp. R245-R248.
Fiumara et al.,"Genotoxic effects of base and prime editing in human hematopoietic stem cells," Nature Biotechnology (2023) vol. No. , pp. 1-15.
Flasch et al., "Genome-wide de novo L1 Retrotransposition Connects Endonuclease Activity with Replication," Cell (2019) vol. 177, p. 877-851.
Fonfara et al., "Creating highly specific nucleases by fusion of active restriction endonucleases and catalytically inactive homing endonucleases," Nucleic Acids Res (2012) 40(2):847-860.
Frangoul et al.,"CRISPR-Cas9 Gene Editing for Sickle Cell Disease and ?- Thalassemia," New Engl J Med (2020) vol. 384, No. 3, pp. 252-260.
Franz et al., "Analysis of tissue-specific gene delivery by recombinant adenoviruses containing cardiac-specific promoters," Cardiovasc. Res. (1997) 35:560-566.
Fu et al.,"High-frequency off-target mutagenesis induced by CRISPR-Cas nucleases in human cells," Nat Biotechnol (2013) vol. 31, No. 9, pp. 822-826.
Fu et al.,"Improving CRISPR-Cas nuclease specificity using truncated guide RNAs," Nat Biotechnol (2014) vol. 32, No. 3, pp. 279-284.
Fujimoto et al.,"Integration of the 5' end of the retrotransposon, R2Bm, can be complemented by homologous recombination," Nucleic Acids Res (2004) vol. 32, No. 4, pp. 1555-1565.
Fujiwara et al.,"Site-specific non-LTR retrotransposons," Microbiol Spectr (2015) vol. 3, No. 2, pp. MDNA3-0001-2014.

Gangopadhyay et al., "Precision control of CRISPR-Cas9 using small molecules and light," Biochemistry (2019) 58(4):234-244.
Gao et al.,"A truncated reverse transcriptase enhances prime editing by split AAV vectors," bioRxiv (2021) vol. No. , pp. 2021.11.05.467423.
Gao et al.,"No observable guide-RNA-independent off-target mutation induced by prime editor," Biorxiv (Apr. 9, 2021) vol. No. , pp. 2021.04.09.439109.
Gao et al.,"Prime editing in mice reveals the essentiality of a single base in driving tissue-specific gene expression," Genome Biol (20210316) vol. 22, No. 1, pp. 83.
Garcia-Rodriguez et al.,"Use of the computer-retargeted group II intron RmIntl of Sinorhizobium meliloti for gene targeting," Rna Biol (2014) vol. 11, No. 4, pp. 391-401.
Garneau et al.,"The CRISPR/Cas bacterial immune system cleaves bacteriophage and plasmid DNA," Nature (2010) vol. 468, No. 7320, pp. 67-71.
Knight et al., "Regulation of the human GLUT4 gene promoter: interaction between a transcriptional activator and myocyte enhancer factor 2A," PNAS (2003) 00(25):14725-14730.
Koblan et al.,"Efficient C:G-to-G:C base editors developed using CRISPRi screens, target-library analysis, and machine learning," Nat Biotechnol (Jun. 28, 2021) vol. 39, No. 11, pp. 1414-1425.
Kocak et al., "Increasing the specificity of CRISPR systems with engineered RNA secondary structures," Nat Biotechnol (2019) 37(6):657-666.
Koeppel et al.,"Predicting efficiency of writing short sequences into the genome using prime editing," bioRxiv (2021) vol. No. , pp. 2021.11.10.468024.
Kojima et al., Recent Expansion of a New Ingi-Related Clade of Vingi non-LTR Retrotransposons in Hedgehogs, Molecular Biology and Evolution (2011) vol. 28, No. 1, pp. 17-20.
Kolb et al.,"Site-directed genome modification: nucleic acid and protein modules for targeted integration and gene correction," (2005) vol. 23, No. 8, pp. 399-406.
Kolhatkar et al., "Active tumor targeting of nanomaterials using folic acid, transferrin and integrin receptors," Curr Drug Discov Technol (2011) 8:197-206.
Komor et al.,"Programmable editing of a target base in genomic DNA without double-stranded DNA cleavage," Nature (2016) vol. 533, No. 7603, pp. 420-424.
Kong et al.,"Precise genome editing without exogenous donor DNA via retron editing system in human cells," Protein Cell (Aug. 17, 2021) vol. 12, No. 11, pp. 899-902.
Kotewicz et al., "Isolation of cloned Moloney murine leukemia virus reverse transcriptase lacking ribonuclease H activity," Nucleic Acids Res (1988) 16(1):265-277.
Kotin, "Prospects for the use of adeno-associated virus as a vector for human gene therapy," Human Gene Therapy (1994) 5:793-801.
Krieg, "Improved synthesis of full-length RNA probe at reduced incubation temperatures," Nucleic Acids Res (1990) 18:6463.
Krokan et al.,"Base Excision Repair," Csh Perspect Biol (2013) vol. 5, No. 4, pp. a012583.
Kuhn et al., "Phosphorothioate cap analogs increase stability and translational efficiency of RNA vaccines in immature dendritic cells and induce superior immune responses in vivo," Gene Therapy (2010) 17:961-971.
Kulmanov et al.,"DeepGO: predicting protein functions from sequence and interactions using a deep ontology-aware classifier," Bioinformatics (2018) vol. 34, No. 4, pp. 660-668.
Kuriki et al., "Structural and functional analysis of a new upstream promoter of the human FAT/CD36 gene," Biol. Pharm. Bull. (2002) 25:1476.
Kurt et al.,"CRISPR C-to-G base editors for inducing targeted DNA transversions in human cells," Nat Biotechnol (Jul. 20, 2020) vol. 39, No. 1, pp. 41-46.
Kurzynska-Kokorniak et al.,"DNA-directed DNA Polymerase and Strand Displacement Activity of the Reverse Transcriptase Encoded by the R2 Retrotransposon," J Mol Biol (2007) vol. 374, No. 2, pp. 322-333.
Kwek et al., "U1 snRNA associates with TFIIH and regulates transcriptional initiation," Nature Structural Biology (2002) 9:800-805.

(56) References Cited

OTHER PUBLICATIONS

Kweon et al., "Engineered prime editors with PAM flexibility," Molecular Therapy (2021) vol. 29, No. 6, pp. 2001-2007.
Kwon et al.,"TAPE-seq is a cell-based method for predicting genome-wide off-target effects of prime editor," Nature Communications (2022) vol. 13, No. 1, pp. 7975.
Laakso et al.,"Replicative fidelity of lentiviral vectors produced by transient transfection," Virology (2006) vol. 348, No. 2, pp. 406-417.
Labno et al., "Cytoplasmic RNA decay pathways—Enzymes and mechanisms," Biochemica et Biophysica Acta (2016) 1863:3125-3147.
Lampson B.C. (2007) Prokaryotic Reverse Transcriptases. In: Polaina J., MacCabe A.P. (eds) Industrial Enzymes. Springer, Dordrecht).
Lathe et al., "A single lineage of r2 retrotransposable elements is an active, evolutionarily stable component of the *Drosophila* rDNA locus," Molecular Biology and Evolution (1997) vol. 14, No. 12, pp. 1232-1241.
Laxa et al., "The 5'UTR Intron of Arabidopsis GGT1 Aminotransferase Enhances Promoter Activity by Recruiting RNA Polymerase II," Plant Physiology (2016) 172:313-327.
Lecuyer et al.,"Mutants of the Bacteriophage MS2 Coat Protein That Alter Its Cooperative Binding to RNA," Biochemistry-us (1995) vol. 34, No. 33, pp. 10600-10606.
Lee et al., "Adenovirus-Mediated Gene Delivery: Potential Applications for Gene and Cell-Based Therapies in the New Era of Personalized Medicine," Genes & Diseases (2017) 4(2):43-63.
Lee et al., "Directed evolution of CRISPR-Cas9 to increase its specificity," Nat Commun (2018) vol. 9, No. 1, pp. 3048.
Leenay et al.,"Identifying and Visualizing Functional PAM Diversity across CRISPR-Cas Systems," Mol Cell (2016) vol. 62, No. 1, pp. 137-147.
Lemaitre et al.,"DSB (Im)mobility and DNA Repair Compartmentalization in Mammalian Cells," J Mol Biol (2015) vol. 427, No. 3, pp. 652-658.
Letunic et al.,"20 years of the SMART protein domain annotation resource," Nucleic Acids Res (2017) vol. 46, No. Database issue, pp. gkx922-.
Levesque et al.,"Nucleotide metabolism constrains prime editing in hematopoietic stem and progenitor cells," bioRxiv (2023) vol. , No. , pp. 2023.10.22.563434.
Li et al., "Enhanced Tropism of Species B1 Adenoviral-Based Vectors for Primary Human Airway Epithelial Cells," Mol Ther Methods Clin Dev (2019)14:228-236.
Li et al., "Expression of the SM22alpha promoter in transgenic mice provides evidence for distinct transcriptional regulatory programs in vascular and visceral smooth muscle cells," J. Cell Biol. (1996) 132, 849-859.
Li et al., "Production and characterization of novel recombinant adeno-associated virus replicative-form genomes: a eukaryotic source of DNA for gene transfer," PLoS One (2013) 8(8):e69879, 14 pages.
Li et al.,"A Review of the Structure, Preparation, and Application of NLCs, PNPs, and PLNs," Nanomaterials 7, 122, 2017.
Li et al.,"Easy-Prime: a machine learning-based prime editor design tool," Genome Biol (Aug. 19, 2021) vol. 22, No. 1, pp. 235.
Li et al.,"Effects of Chemically Modified Messenger RNA on Protein Expression," Bioconjugate Chem (2016) vol. 27, No. 3, pp. 849-853.
Li et al.,"Highly efficient prime editing by introducing same-sense mutations in pegRNA or stabilizing its structure," Nature Communications (2022) vol. 13, No. 1, pp. 1669.
Li et al.,"In vivo HSC prime editing rescues sickle cell disease in a mouse model," Blood (2023) vol. 141, No. 17, pp. 2085-2099.
Li et al.,"piggyBac transposase tools for genome engineering," Proc National Acad Sci (2013) vol. 110, No. 25, pp. E2279-E2287.
Li et al.,"Prime editing-mediated correction of the CFTR W1282X mutation in iPSCs and derived airway epithelial cells," Plos One (2023) vol. 18, No. 11, pp. e0295009.

Lieber et al.,"Prospects and challenges of in vivo hematopoietic stem cell genome editing for hemoglobinopathies," Molecular Therapy (2023) vol. 31, No. 10, pp. 2823-2825.
Lim et al., "Mixed tailing by TENT4A and TENT4B shields mRNA from rapid deadenylation," Science (2018) 361:701-704.
Lin et al., "The splicing factor SC35 has an active role in transcriptional elongation," Nature Structural and Molecular Biology (2008) 15:819-826.
Lin et al.,"High-efficiency prime editing with optimized, paired pegRNAs in plants," Nat Biotechnol (Mar. 25, 2021) vol. 39, No. 8, pp. 923-927.
Lin et al.,"Modeling a cataract disorder in mice with prime editing," Molecular Therapy—Nucleic Acids (2021) vol. 25, No., pp. 494-501.
Linn et al., "Conservation of an AE3 Cl-/HCO3-exchanger cardiac-specific exon and promoter region and AE3 mRNA expression patterns in murine and human hearts," Circ. Res. (1995) 6(4):584-591.
Lisowski et al., "Selection and evaluation of clinically relevant AAV variants in a xenograft liver model," Nature (2014) 506:382-386.
[No Author Listed] GenBank 5-HT1C serotonin receptor {promoter region} [mice, Genomic, 1859 nt] S62283.1 (1993).
[No AuthorListed] GenBank Human synapsin I gene, 5' end, Accession M55301 J05630 (1995) 2 pages.
Adamala et al.,"Programmable RNA-binding protein composed of repeats of a single modular unit," Proc National Acad Sci (2016) vol. 113, No. 19, pp. E2579-E2588.
Adikusuma et al.,"Optimized nickase- and nuclease-based prime editing in human and mouse cells," Biorxiv (Jul. 2, 2021) vol. , No. , pp. 2021.07.01.450810.
Aird et al.,"Increasing Cas9-mediated homology-directed repair efficiency through covalent tethering of DNA repair template," Commun Biology (2018) vol. 1, No. 1, pp. 54.
Aird et al.,"Split *Staphylococcus aureus* prime editor for AAV delivery," bioRxiv (2021) vol. , No. , pp. 2021.01.11.426237.
Akinc et al., "Targeted delivery of RNAi therapeutics with endogenous and exogenous ligand-based mechanisms," Mol Ther 18(7):1357-1364 (2010).
Akyürek et al., "SM22alpha promoter targets gene expression to vascular smooth muscle cells in vitro and in vivo," Mol. Med. (2000) 6(11):983-91.
Almada et al., "Promoter directionality is controlled by U1 snRNP and polyadenylation signals," Nature (2013) 499:360-363.
Altae-Tran et al.,"The widespread IS200/605 transposon family encodes diverse programmable RNA-guided endonucleases," Science (Sep. 9, 2021) vol. 374, No. 6563, pp. 57-65.
An et al., "Plug and play modular strategies for synthetic retrotransposons," Methods (2009) vol. 49, pp. 227-235.
Anand et al., "Structure based design of protein linkers for zinc finger nuclease," FEBS Letters, 587:19, 2013.
Anders et al.,"Structural basis of PAM-dependent target DNA recognition by the Cas9 endonuclease," Nature (2014) vol. 513, No. 7519, pp. 569-573.
Andersen et al., "Herpesvirus-mediated gene delivery into the rat brain: specificity and efficiency of the neuron-specific enolase promoter," Cell. Mol. Neurobiol., 13:503-15 (1993).
Anderson et al.,"pegIT—a web-based design tool for prime editing," Nucleic Acids Res (Jul. 2, 2021) vol. 49, No. W1, pp. gkab427.
Andries et al.,"N1-methylpseudouridine-incorporated mRNA outperforms pseudouridine-incorporated mRNA by providing enhanced protein expression and reduced immunogenicity in mammalian cell lines and mice," J Control Release (2015) vol. 217, pp. 337-344.
Anzalone et al., Search-and replace genome editing without double-strand breaks or donor DNA, Nature (2019) vol. 576, No. 7785, pp. 149-157.
Anzalone et al., "Genome editing with CRISPR-Cas nucleases, base editors, transposases and prime editors," Nature Biotechnology (2020) vol. 38, No. 7, pp. 824-844.
Arbuthnot et al., "In vitro and in vivo hepatoma cell-specific expression of a gene transferred with an adenoviral vector" Hum. Gene Ther., 7:1503-14 (1996).

(56) References Cited

OTHER PUBLICATIONS

Ardeljan et al.,"Cell fitness screens reveal a conflict between Line-1 retrotransposition and DNA replication," Nat Struct Mol Biol (2020) vol. 27, No. 2, pp. 168-178.
Asmari et al. "Thermophoresis for characterizing biomolecular interaction," Methods (2018) 146:107-119.
Asrani et al., "Optimization of mRNA untranslated regions for improved expression of therapeutic mRNA," RNA biology 15, 756-762 (2018).
Babushok et al., "Progress in understanding the biology of the human mutagen Line-1," Human Mutation (2007) vol. 28, No. 6, pp. 527-539.
Bader et al.,"The roles of RNA in DNA double-strand break repair," Brit J Cancer (2020) vol. 122, No. 5, pp. 613-623.
Bailey et al., "The MEME Suite," Nucleic Acids Research (2015) vol. 43, pp. W39-W49.
Baltimore, "Expression of animal virus genomes," Bacteriol Rev 35(3):235-241 (1971).
Banerjee et al., "Hematopoietic stem cells and retroviral infection," Retrovirology (2010) vol. 7, No. 1, pp. 8.
Bao et al., "Repbase Update, a database of repetitive elements in eukaryotic genomes," Mobile DNA (2015) vol. 6, Article 11, 6 pages.
Baranauskas et al.,"Generation and characterization of new highly thermostable and processive M-MuLV reverse transcriptase variants," Protein Eng Des Sel (2012) vol. 25, No. 10, pp. 657-668.
Bartge et al., "Transgenic mice express the human phenylethanolamine N-methyltransferase gene in adrenal medulla and retina," Proc. Natl. Acad. Sci. USA (1988) 85:3648-3652.
Bateman et al.,"UniProt: the universal protein knowledgebase," Nucleic Acids Res (2017) vol. 45, No. D1, pp. D158- D169.
Bednarek et al., "mRNAs biotinylated within the 5' cap and protected against decapping: new tools to capture RNA-protein complexes," Phil Trans R Soc B (2018) vol. 373, Article 20180167, 12 pages.
Beerli, et al., "Engineering polydactyl zinc-finger transcription factors," Nature Biotechnol. (2002) 20:135-141.
Belfort et al., "Group II Intron RNPs and Reverse Transcriptases—From Retroelements to Research Tools," Cold Spring Harbor Perspectives in Biology (2019) 11:a032375, 17 pages.
Bell et al., "In silico design and validation of high-affinity RNA aptamers targeting epithelial cellular adhesion molecule dimers," PNAS 117(15):8486-8493. (2020).
Bellaousov et al., "RNAstructure: Web servers for RNA secondary structure prediction and analysis," Nucleic Acids Res 41:W471-W474 (2013).
Ben-Arie et al., "Integrin-targeted nanoparticles for siRNA delivery," Methods Mol Biol.( 2012 757:497-507.
Benitez-Guijarro et al.,"RNase H2, mutated in Aicardi-Goutieres syndrome, promotes Line-1 retrotransposition," Embo J (2018) vol. 37, No. 15, Article e98506, 22 pages.
Benoit et al., "Synthesis of folate-functionalized RAFT polymers for targeted siRNA delivery," Biomacromolecules (2011) 12: 2708-2714.
Berg et al., "U1 snRNP determines mRNA length and regulates isoform expression," Cell (2012) 150:53-64.
Bhattarai-Kline et al.,"Reconstructing transcriptional histories by CRISPR acquisition of retron-based genetic barcodes," Biorxiv (Aug. 12, 2021) vol. , No. , pp. 2021.08.11.455990.
Bibillo et al., "High Processivity of the Reverse Transcriptase from a Non-long Terminal Repeat Retrotransposon," J Biol Chem (2002) vol. 277, No. 38, pp. 34836-34845.
Bibillo et al., "The Reverse Transcriptase of the R2 Non-LTR Retrotransposon: Continuous Synthesis of cDNA on Non-continuous RNA Templates," J Mol Biol (2002) vol. 316, pp. 459-473.
Bieberstein et al., "First exon length controls active chromatin signatures and transcription," Cell Reports (2012) 2:62-68.
Birbach et al., "Cytosolic, nuclear and nucleolar localization signals determine subcellular distribution and activity of the NF-kappaB inducing kinase NIK," Journal of Cell Science (2004) 117:3615-3624.
Bitter et al., "Expression and secretion vectors for yeast," Methods in Enzymology (1987) 153:516-544.
Bock et al.,"In vivo prime editing of a metabolic liver disease in mice," Science Translational Medicine (2022) vol. 14, No. 636, pp. eabl9238.
Bock et al.,"Treatment of a metabolic liver disease by in vivo prime editing in mice," Biorxiv (Aug. 17, 2021) vol. , No. , pp. 2021.08.17.456632.
Boehme et al., "The sleeping beauty transposon vector system for treatment of rare genetic diseases: an unrealized hope?" Curr Gene Ther (2015) 15(3):255-265.
Bogdanove et al. "TAL effectors: customizable proteins for DNA targeting," Science (2011) 333(6051):1843-61846.

\* cited by examiner (1) Build library of gene modifying polypeptide candidates:

(2) Screen pools from a library with ~18,000 candidates to evaluate performance of combinations of Cas, linkers and retrovirus RT variants

METHODS AND COMPOSITIONS FOR MODULATING A GENOME

RELATED APPLICATIONS

This application is a continuation of International Application No. PCT/US2022/076045, filed Sep. 7, 2022, which claims priority to U.S. Ser. No. 63/241,953, filed Sep. 8, 2021 and 63/373,444, filed Aug. 24, 2022, the entire contents of each of which is incorporated herein by reference.

SEQUENCE LISTING

The instant application contains a Sequence Listing which has been submitted electronically in XML format and is hereby incorporated by reference in its entirety. Said XML copy, created on Jul. 20, 2023, is named V2065-702320FT_SL.xml and is 20,090,558 bytes in size.

BACKGROUND

Integration of a nucleic acid of interest into a genome occurs at low frequency and with little site specificity, in the absence of a specialized protein to promote the insertion event. Some existing approaches, like CRISPR/Cas9, are more suited for small edits that rely on host repair pathways, and are less effective at integrating longer sequences. Other existing approaches, like Cre/1oxP, require a first step of inserting a 1oxP site into the genome and then a second step of inserting a sequence of interest into the 1oxP site. There is a need in the art for improved compositions (e.g., proteins and nucleic acids) and methods for inserting, altering, or deleting sequences of interest in a genome.

SUMMARY OF THE INVENTION

This disclosure relates to novel compositions, systems and methods for altering a genome at one or more locations in a host cell, tissue or subject, in vivo or in vitro. In particular, the invention features compositions, systems and methods for inserting, altering, or deleting sequences of interest in a host genome.

Features of the compositions or methods can include one or more of the following enumerated embodiments.

1. A gene modifying polypeptide comprising:
   a DNA binding domain (DBD) that binds to a target nucleic acid sequence and
   a reverse transcriptase (RT) domain of Table 1, or a sequence having at least 70%, 75%, 80%, 85%, 90%, 95%, 97%, 98%, or 99% identity thereto (e.g., to a sequence as listed for the RT domain in Table 6); wherein the DBD is heterologous to the RT domain (e.g., a Cas domain, e.g., a Cas nickase domain, e.g., a Cas9 nickase domain); optionally wherein the RT domain is C-terminal of the Cas domain; and
   a linker disposed between the RT domain and the Cas domain, wherein the linker has a sequence from the same row of Table 1 as the RT domain, or a sequence having at least 70%, 75%, 80%, 85%, 90%, 95%, 97%, 98%, or 99% identity thereto.
2. The gene modifying polypeptide of embodiment 1, wherein the RT domain has a sequence with at least 90% identity to the RT domain of Table 1.
3. The gene modifying polypeptide of any of the preceding embodiments, wherein the RT domain has a sequence with at least 95% identity to the RT domain of Table 1.
4. The gene modifying polypeptide of any of the preceding embodiments, wherein the RT domain has a sequence with at least 98% identity to the RT domain of Table 1.
5. The gene modifying polypeptide of any of the preceding embodiments, wherein the RT domain has a sequence with at least 99% identity to the RT domain of Table 1.
6. The gene modifying polypeptide of any of the preceding embodiments, wherein the RT domain has a sequence with 100% identity to the RT domain of Table 1.
7. The gene modifying polypeptide of any of the preceding embodiments, wherein the linker has a sequence with at least 90% identity to the linker sequence from the same row of Table 1 as the RT domain.
8. The gene modifying polypeptide of any of the preceding embodiments, wherein the linker has a sequence with at least 95% identity to the linker sequence from the same row of Table 1 as the RT domain.
9. The gene modifying polypeptide of any of the preceding embodiments, wherein the linker has a sequence with at least 97% identity to the linker sequence from the same row of Table 1 as the RT domain.
10. The gene modifying polypeptide of any of the preceding embodiments, wherein the linker has a sequence with 100% identity to the linker sequence from the same row of Table 1 as the RT domain.
11. The gene modifying polypeptide of any of the preceding embodiments, wherein the RT domain comprises a mutation as listed in Table 2.
12. The gene modifying polypeptide of any of the preceding embodiments, wherein the Cas domain comprises a sequence of Table 7 or 8, or a sequence having at least 70%, 75%, 80%, 85%, 90%, 95%, 98%, or 99% identity thereto.
13. The gene modifying polypeptide of any of the preceding embodiments, wherein the Cas domain is a Cas nickase domain.
14. The gene modifying polypeptide of any of the preceding embodiments, wherein the Cas domain is a Cas9 nickase domain.
15. The gene modifying polypeptide of any of the preceding embodiments, wherein the Cas domain comprises an N863A mutation.
16. The gene modifying polypeptide of any of the preceding embodiments, which comprises an NLS, e.g., wherein the gene modifying polypeptide comprises two NLSs.
17. The gene modifying polypeptide of any of the preceding embodiments, which comprises an NLS N-terminal of the Cas9 domain.
18. The gene modifying polypeptide of any of the preceding embodiments, which comprises an NLS C-terminal of the RT domain.
19. The gene modifying polypeptide of any of the preceding embodiments, which comprises a first NLS which is N-terminal of the Cas9 domain and a second NLS which is C-terminal of the RT domain.
20. The gene modifying polypeptide of any of the preceding embodiments, which comprises a sequence of SEQ ID NO: 4000 which comprises the first NLS and the Cas domain, or a sequence having at least 70%, 75%, 80%, 85%, 90%, 95%, 98%, or 99% identity thereto.
21. The gene modifying polypeptide of any of the preceding embodiments, which comprises a sequence of SEQ ID NO: 4001 which comprises the second NLS, or a sequence having at least 70%, 75%, 80%, 85%, 90%, 95%, 98%, or 99% identity thereto.

22. The gene modifying polypeptide of any of the preceding embodiments, which comprises a GG amino acid sequence between the Cas domain and the linker.

23. The gene modifying polypeptide of any of the preceding embodiments, which comprises an AG amino acid sequence between the RT domain and the second NLS.

24. The gene modifying polypeptide of any of the preceding embodiments, which comprises a GG amino acid sequence between the linker and the RT domain.

25. The gene modifying polypeptide of any of the preceding embodiments, which comprises an amino acid sequence according to any of SEQ ID NOs: 1-3332 in the sequence listing, or a sequence having at least 70%, 75%, 80%, 85%, 90%, 95%, 97%, 98%, or 99% identity thereto.

26. The gene modifying polypeptide of any of the preceding embodiments, which comprises an amino acid sequence with at least 90% identity to any of SEQ ID NOs: 1-3332 in the sequence listing.

27. The gene modifying polypeptide of any of the preceding embodiments, which comprises an amino acid sequence with at least 95% identity to any of SEQ ID NOs: 1-3332 in the sequence listing.

28. The gene modifying polypeptide of any of the preceding embodiments, which comprises an amino acid sequence with at least 98% identity to any of SEQ ID NOs: 1-3332 in the sequence listing.

29. The gene modifying polypeptide of any of the preceding embodiments, which comprises an amino acid sequence with at least 99% identity to any of SEQ ID NOs: 1-3332 in the sequence listing.

30. The gene modifying polypeptide of any of the preceding embodiments, which comprises an amino acid sequence with 100% identity to any of SEQ ID NOs: 1-3332 in the sequence listing.

31. The gene modifying polypeptide of any of the preceding embodiments, which produces an increase in converted GFP+ of at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% relative to unsorted input cells in an assay of Example 2 using HEK cells (e.g., HEK293T cells) and g4 guide RNA.

32. The gene modifying polypeptide of any of the preceding embodiments, which produces an increase in converted GFP+ of at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% relative to unsorted input cells in an assay of Example 2 using U2-OS cells and g4 guide RNA.

33. The gene modifying polypeptide of any of the preceding embodiments, which produces an increase in converted GFP+ of at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% relative to unsorted input cells in an assay of Example 2 using HEK cells (e.g., HEK293T cells) and g10 guide RNA.

34. The gene modifying polypeptide of any of the preceding embodiments, which has an activity that is at least 50%, 60%, 70%, 80%, or 90% of the activity of a gene modifying polypeptide comprising, in an N-terminal to C-terminal direction:
   a) an NLS and Cas domain sequence of SEQ ID NO: 4000;
   b) a linker having the sequence EAAAKGSS (SEQ ID NO: 5152);
   c) an RT domain having the sequence of PERV_Q4VFZ2_3mutA_WS; and
   d) an NLS sequence of SEQ ID NO: 4001,
in an assay of Example 1 using HEK cells and g4 guide RNA.

35. The gene modifying polypeptide of any of the preceding embodiments, which has an activity that is at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% greater than the activity of a gene modifying polypeptide comprising a sequence of SEQ ID NO: 4002 in an assay of Example 1, e.g., using HEK cells and g4 guide RNA.

36. A nucleic acid (e.g., DNA or RNA, e.g., mRNA) encoding the gene modifying polypeptide of any of the preceding embodiments.

37. A cell comprising the gene modifying polypeptide of any of embodiments 1-35 or the nucleic acid of embodiment 36.

38. A system comprising:
   i) the gene modifying polypeptide of any of embodiments 1-35, and
   ii) a template RNA that comprises:
      a) a gRNA spacer that is complementary to a portion a target nucleic acid sequence;
      b) a gRNA scaffold that binds the Cas domain of the gene modifying polypeptide;
      c) a heterologous object sequence; and
      d) a primer binding site sequence (PBS sequence).

39. A method for modifying a target nucleic acid in a cell (e.g., a human cell), the method comprising contacting the cell with the system of embodiment 38, or nucleic acid encoding the same, thereby modifying the target nucleic acid.

40. A gene modifying polypeptide comprising:
   a Cas domain (e.g., a Cas nickase domain, e.g., a Cas9 nickase domain);
   a reverse transcriptase (RT) domain comprising the RT domain of a reference gene modifying polypeptide having the sequence of any one of SEQ ID NOs: 1-7743, or a sequence having at least 70%, 75%, 80%, 85%, 90%, 95%, 97%, 98%, or 99% identity thereto, wherein the RT domain is C-terminal of the Cas domain; and
   a linker disposed between the RT domain and the Cas domain, wherein the linker comprises the linker of said reference gene modifying polypeptide, or a sequence having at least 70%, 75%, 80%, 85%, 90%, 95%, 97%, 98%, or 99% identity thereto.

41. The gene modifying polypeptide of embodiment 40, wherein the reference gene modifying polypeptide has the amino acid sequence of a SEQ ID NO as listed in Table 1.

42. The gene modifying polypeptide of embodiment 40, wherein the reference gene modifying polypeptide has the amino acid sequence of a SEQ ID NO as listed in Table A1.

43. The gene modifying polypeptide of embodiment 40, wherein the reference gene modifying polypeptide has the amino acid sequence of a SEQ ID NO as listed in Table A5.

44. The gene modifying polypeptide of embodiment 40, wherein the reference gene modifying polypeptide has the amino acid sequence of a SEQ ID NO as listed in Table D1.

45. The gene modifying polypeptide of embodiment 40, wherein the reference gene modifying polypeptide has the amino acid sequence of a SEQ ID NO as listed in Table D2.

46. The gene modifying polypeptide of embodiment 40, wherein the reference gene modifying polypeptide has the amino acid sequence of a SEQ ID NO as listed in Table D3.

47. The gene modifying polypeptide of embodiment 40, wherein the reference gene modifying polypeptide has the amino acid sequence of a SEQ ID NO as listed in Table D4.

48. The gene modifying polypeptide of embodiment 40, wherein the reference gene modifying polypeptide has the amino acid sequence of a SEQ ID NO as listed in Table D5.

49. The gene modifying polypeptide of embodiment 40, wherein the reference gene modifying polypeptide has the amino acid sequence of a SEQ ID NO as listed in Table D6.

50. The gene modifying polypeptide of embodiment 40, wherein the reference gene modifying polypeptide has the amino acid sequence of a SEQ ID NO as listed in Table D7.

51. The gene modifying polypeptide of embodiment 40, wherein the reference gene modifying polypeptide has the amino acid sequence of a SEQ ID NO as listed in Table D8.

52. The gene modifying polypeptide of embodiment 40, wherein the reference gene modifying polypeptide has the amino acid sequence of a SEQ ID NO as listed in Table D9.

53. The gene modifying polypeptide of embodiment 40, wherein the reference gene modifying polypeptide has the amino acid sequence of a SEQ ID NO as listed in Table D10.

54. The gene modifying polypeptide of embodiment 40, wherein the reference gene modifying polypeptide has the amino acid sequence of a SEQ ID NO as listed in Table D11.

55. The gene modifying polypeptide of embodiment 40, wherein the reference gene modifying polypeptide has the amino acid sequence of a SEQ ID NO as listed in Table D12.

56. The gene modifying polypeptide of embodiment 40, wherein the reference gene modifying polypeptide has the amino acid sequence of a SEQ ID NO as listed in Table T1.

57. The gene modifying polypeptide of embodiment 40, wherein the reference gene modifying polypeptide has the amino acid sequence of a SEQ ID NO as listed in Table T2.

58. The gene modifying polypeptide of embodiment 40, wherein the reference gene modifying polypeptide is an AVIRE polypeptide (e.g., as described herein), and wherein the linker comprises an amino acid sequence as listed in FIG. 11.

59. A gene modifying polypeptide comprising:
a Cas domain (e.g., a Cas nickase domain, e.g., a Cas9 nickase domain);
a reverse transcriptase (RT) domain of Table 1, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker has a sequence from the same row of Table 1 as the RT domain, or a sequence having at least 70%, 75%, 80%, 85%, 90%, 95%, 97%, 98%, or 99% identity thereto.

60. A gene modifying polypeptide comprising:
a Cas domain (e.g., a Cas nickase domain, e.g., a Cas9 nickase domain);
a reverse transcriptase (RT) domain of Table A1, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table A1 as the RT domain, or a sequence having at least 70%, 75%, 80%, 85%, 90%, 95%, 97%, 98%, or 99% identity thereto.

61. A gene modifying polypeptide comprising:
a Cas domain (e.g., a Cas nickase domain, e.g., a Cas9 nickase domain);
a reverse transcriptase (RT) domain of Table A5, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D1 as the RT domain, or a sequence having at least 70%, 75%, 80%, 85%, 90%, 95%, 97%, 98%, or 99% identity thereto.

62. A gene modifying polypeptide comprising:
a Cas domain (e.g., a Cas nickase domain, e.g., a Cas9 nickase domain);
a reverse transcriptase (RT) domain of Table T1, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D1 as the RT domain, or a sequence having at least 70%, 75%, 80%, 85%, 90%, 95%, 97%, 98%, or 99% identity thereto.

63. A gene modifying polypeptide comprising:
a Cas domain (e.g., a Cas nickase domain, e.g., a Cas9 nickase domain);
a reverse transcriptase (RT) domain of Table T2, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D1 as the RT domain, or a sequence having at least 70%, 75%, 80%, 85%, 90%, 95%, 97%, 98%, or 99% identity thereto.

64. A gene modifying polypeptide comprising:
a Cas domain (e.g., a Cas nickase domain, e.g., a Cas9 nickase domain);
a reverse transcriptase (RT) domain of Table D1, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D1 as the RT domain, or a sequence having at least 70%, 75%, 80%, 85%, 90%, 95%, 97%, 98%, or 99% identity thereto.

65. A gene modifying polypeptide comprising:
a Cas domain (e.g., a Cas nickase domain, e.g., a Cas9 nickase domain);
a reverse transcriptase (RT) domain of Table D2, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D2 as the RT domain, or a sequence having at least 70%, 75%, 80%, 85%, 90%, 95%, 97%, 98%, or 99% identity thereto.

66. A gene modifying polypeptide comprising:
a Cas domain (e.g., a Cas nickase domain, e.g., a Cas9 nickase domain);
a reverse transcriptase (RT) domain of Table D3, or a sequence having at least 70%, 75%, 80%, 85%, 90%, 95%, 97%, 98%, or 99% identity thereto, wherein the RT domain is C-terminal of the Cas domain; and a linker disposed between the RT domain and the Cas domain, wherein the linker comprises a sequence from the same row of Table D3 as the RT domain, or a sequence having at least 70%, 75%, 80%, 85%, 90%, 95%, 97%, 98%, or 99% identity thereto.

67. A gene modifying polypeptide comprising:
a Cas domain (e.g., a Cas nickase domain, e.g., a Cas9 nickase domain);
a reverse transcriptase (RT) domain of Table D4, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D4 as the RT domain, or a sequence having at least 70%, 75%, 80%, 85%, 90%, 95%, 97%, 98%, or 99% identity thereto.

68. A gene modifying polypeptide comprising:
a Cas domain (e.g., a Cas nickase domain, e.g., a Cas9 nickase domain);
a reverse transcriptase (RT) domain of Table D5, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D5 as the RT domain, or a sequence having at least 70%, 75%, 80%, 85%, 90%, 95%, 97%, 98%, or 99% identity thereto.

69. A gene modifying polypeptide comprising:
a Cas domain (e.g., a Cas nickase domain, e.g., a Cas9 nickase domain);
a reverse transcriptase (RT) domain of Table D6, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D6 as the RT domain, or a sequence having at least 70%, 75%, 80%, 85%, 90%, 95%, 97%, 98%, or 99% identity thereto.

70. A gene modifying polypeptide comprising:
a Cas domain (e.g., a Cas nickase domain, e.g., a Cas9 nickase domain);
a reverse transcriptase (RT) domain of Table D7, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D7 as the RT domain, or a sequence having at least 70%, 75%, 80%, 85%, 90%, 95%, 97%, 98%, or 99% identity thereto.

71. A gene modifying polypeptide comprising:
a Cas domain (e.g., a Cas nickase domain, e.g., a Cas9 nickase domain);
a reverse transcriptase (RT) domain of Table D8, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D8 as the RT domain, or a sequence having at least 70%, 75%, 80%, 85%, 90%, 95%, 97%, 98%, or 99% identity thereto.

72. A gene modifying polypeptide comprising:
a Cas domain (e.g., a Cas nickase domain, e.g., a Cas9 nickase domain);
a reverse transcriptase (RT) domain of Table D9, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D9 as the RT domain, or a sequence having at least 70%, 75%, 80%, 85%, 90%, 95%, 97%, 98%, or 99% identity thereto.

73. A gene modifying polypeptide comprising:
a Cas domain (e.g., a Cas nickase domain, e.g., a Cas9 nickase domain);
a reverse transcriptase (RT) domain of Table D10, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D10 as the RT domain, or a sequence having at least 70%, 75%, 80%, 85%, 90%, 95%, 97%, 98%, or 99% identity thereto.

74. A gene modifying polypeptide comprising:
a Cas domain (e.g., a Cas nickase domain, e.g., a Cas9 nickase domain);
a reverse transcriptase (RT) domain of Table D11, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D11 as the RT domain, or a sequence having at least 70%, 75%, 80%, 85%, 90%, 95%, 97%, 98%, or 99% identity thereto.

75. A gene modifying polypeptide comprising:
a Cas domain (e.g., a Cas nickase domain, e.g., a Cas9 nickase domain);
a reverse transcriptase (RT) domain of Table D12, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table D12 as the RT domain, or a sequence having at least 70%, 75%, 80%, 85%, 90%, 95%, 97%, 98%, or 99% identity thereto.

76. A gene modifying polypeptide comprising:
a Cas domain (e.g., a Cas nickase domain, e.g., a Cas9 nickase domain);
a reverse transcriptase (RT) domain of Table T1, or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence from the same row of Table T1 as the RT domain, or a sequence having at least 70%, 75%, 80%, 85%, 90%, 95%, 97%, 98%, or 99% identity thereto.

77. A gene modifying polypeptide comprising:
a Cas domain (e.g., a Cas nickase domain, e.g., a Cas9 nickase domain);
a reverse transcriptase (RT) domain of Table T2, or a sequence having at least 70%, 75%, 80%, 85%, 90%, 95%, 97%, 98%, or 99% identity thereto, wherein the RT domain is C-terminal of the Cas domain; and a linker disposed between the RT domain and the Cas domain, wherein the linker comprises a sequence from the same row of Table T2 as the RT domain, or a sequence having at least 70%, 75%, 80%, 85%, 90%, 95%, 97%, 98%, or 99% identity thereto.

78. A gene modifying polypeptide comprising:
a Cas domain (e.g., a Cas nickase domain, e.g., a Cas9 nickase domain);
an AVIRE reverse transcriptase (RT) domain (e.g., as described herein), or a sequence having at least 70%, 75%, 80%, 85%, 90%, 95%, 97%, 98%, or 99% identity thereto, wherein the RT domain is C-terminal of the Cas domain; and
a linker disposed between the RT domain and the Cas domain, wherein the linker comprises a sequence as listed in FIG. 11, or a sequence having at least 70%, 75%, 80%, 85%, 90%, 95%, 97%, 98%, or 99% identity thereto.

79. The gene modifying polypeptide of any one of embodiments 1-78, wherein the RT domain comprises an amino acid sequence of an AVIRE RT domain (e.g., as described in Table 6), or a sequence having at least 70%, 75%, 80%, 85%, 90%, 95%, 97%, 98%, 99%, or 100% identity thereto.

80. The gene modifying polypeptide of any one of embodiments 1-78, wherein the RT domain comprises an amino acid sequence of an BAEVM RT domain (e.g., as described in Table 6), or a sequence having at least 70%, 75%, 80%, 85%, 90%, 95%, 97%, 98%, 99%, or 100% identity thereto.

81. The gene modifying polypeptide of any one of embodiments 1-78, wherein the RT domain comprises an amino acid sequence of an FFV RT domain (e.g., as described in Table 6), or a sequence having at least 70%, 75%, 80%, 85%, 90%, 95%, 97%, 98%, 99%, or 100% identity thereto.

82. The gene modifying polypeptide of any one of embodiments 1-78, wherein the RT domain comprises an amino acid sequence of an FLV RT domain (e.g., as described in Table 6), or a sequence having at least 70%, 75%, 80%, 85%, 90%, 95%, 97%, 98%, 99%, or 100% identity thereto.

83. The gene modifying polypeptide of any one of embodiments 1-78, wherein the RT domain comprises an amino acid sequence of an FOAMV RT domain (e.g., as described in Table 6), or a sequence having at least 70%, 75%, 80%, 85%, 90%, 95%, 97%, 98%, 99%, or 100% identity thereto.

84. The gene modifying polypeptide of any one of embodiments 1-78, wherein the RT domain comprises an amino acid sequence of an GALV RT domain (e.g., as described in Table 6), or a sequence having at least 70%, 75%, 80%, 85%, 90%, 95%, 97%, 98%, 99%, or 100% identity thereto.

85. The gene modifying polypeptide of any one of embodiments 1-78, wherein the RT domain comprises an amino acid sequence of an KORV RT domain (e.g., as described in Table 6), or a sequence having at least 70%, 75%, 80%, 85%, 90%, 95%, 97%, 98%, 99%, or 100% identity thereto.

86. The gene modifying polypeptide of any one of embodiments 1-78, wherein the RT domain comprises an amino acid sequence of an MLVAV RT domain (e.g., as described in Table 6), or a sequence having at least 70%, 75%, 80%, 85%, 90%, 95%, 97%, 98%, 99%, or 100% identity thereto.

87. The gene modifying polypeptide of any one of embodiments 1-78, wherein the RT domain comprises an amino acid sequence of an MLVBM RT domain (e.g., as described in Table 6), or a sequence having at least 70%, 75%, 80%, 85%, 90%, 95%, 97%, 98%, 99%, or 100% identity thereto.

88. The gene modifying polypeptide of any one of embodiments 1-78, wherein the RT domain comprises an amino acid sequence of an MLVCB RT domain (e.g., as described in Table 6), or a sequence having at least 70%, 75%, 80%, 85%, 90%, 95%, 97%, 98%, 99%, or 100% identity thereto.

89. The gene modifying polypeptide of any one of embodiments 1-78, wherein the RT domain comprises an amino acid sequence of an MLVFF RT domain (e.g., as described in Table 6), or a sequence having at least 70%, 75%, 80%, 85%, 90%, 95%, 97%, 98%, 99%, or 100% identity thereto.

90. The gene modifying polypeptide of any one of embodiments 1-78, wherein the RT domain comprises an amino acid sequence of an MLVMS RT domain (e.g., as described in Table 6), or a sequence having at least 70%, 75%, 80%, 85%, 90%, 95%, 97%, 98%, 99%, or 100% identity thereto.

91. The gene modifying polypeptide of any one of embodiments 1-78, wherein the RT domain comprises an amino acid sequence of an PERV RT domain (e.g., as described in Table 6), or a sequence having at least 70%, 75%, 80%, 85%, 90%, 95%, 97%, 98%, 99%, or 100% identity thereto.

92. The gene modifying polypeptide of any one of embodiments 1-78, wherein the RT domain comprises an amino acid sequence of an SFV1 RT domain (e.g., as described in Table 6), or a sequence having at least 70%, 75%, 80%, 85%, 90%, 95%, 97%, 98%, 99%, or 100% identity thereto.

93. The gene modifying polypeptide of any one of embodiments 1-78, wherein the RT domain comprises an amino acid sequence of an SFV3L RT domain (e.g., as described in Table 6), or a sequence having at least 70%, 75%, 80%, 85%, 90%, 95%, 97%, 98%, 99%, or 100% identity thereto.

94. The gene modifying polypeptide of any one of embodiments 1-78, wherein the RT domain comprises an amino acid sequence of an WMSV RT domain (e.g., as described in Table 6), or a sequence having at least 70%, 75%, 80%, 85%, 90%, 95%, 97%, 98%, 99%, or 100% identity thereto.

95. The gene modifying polypeptide of any one of embodiments 1-78, wherein the RT domain comprises an amino acid sequence of an XMRV6 RT domain (e.g., as described in Table 6), or a sequence having at least 70%, 75%, 80%, 85%, 90%, 95%, 97%, 98%, 99%, or 100% identity thereto.

96. The gene modifying polypeptide of any one of embodiments 1-78, wherein the RT domain comprises an amino acid sequence of an MLVAV, MLVBM, BAEVM, FLV, FOAMV, GALV, KORV, AVIRE, MLVCB, MLVFF, MLVMS, SFV3L, WMSV, or XMRV6 RT domain (e.g., as described in Table 6), or a sequence having at least 70%, 75%, 80%, 85%, 90%, 95%, 97%, 98%, 99%, or 100% identity thereto.

97. The gene modifying polypeptide of any one of embodiments 1-78, wherein the RT domain comprises an amino acid sequence of a gammaretroviral RT domain, or a sequence having at least 70%, 75%, 80%, 85%, 90%, 95%, 97%, 98%, 99%, or 100% identity thereto.

98. The gene modifying polypeptide of embodiment 97, wherein the RT domain comprises an amino acid sequence of an GALV, MLVAV, MLVBM, BAEVM, FLV, AVIRE, KORV, MLVCB, MLVFF, WMSV, XMRV6, MLVMS, and PERV RT domain (e.g., as described in Table 6), or a sequence having at least 70%, 75%, 80%, 85%, 90%, 95%, 97%, 98%, 99%, or 100% identity thereto.

99. The gene modifying polypeptide of any embodiment 40, wherein the RT domain comprises an amino acid sequence of an RT domain as listed in any one of Tables 1, A1, A5, D1-D12, T1, or T2, or a sequence having at least 70%, 75%, 80%, 85%, 90%, 95%, 97%, 98%, or 99% identity thereto.

100. The gene modifying polypeptide of embodiment 40, wherein the linker comprises an amino acid sequence of a linker as listed in any one of Tables 1, A1, A5, D1-D12, T1, or T2, or a sequence having at least 70%, 75%, 80%, 85%, 90%, 95%, 97%, 98%, or 99% identity thereto.

101. The gene modifying polypeptide of embodiment 40,
   wherein the RT domain comprises an amino acid sequence of an RT domain as listed in any one of Tables 1, A1, A5, D1-D12, T1, or T2, or a sequence having at least 70%, 75%, 80%, 85%, 90%, 95%, 97%, 98%, or 99% identity thereto; and
   wherein the linker comprises an amino acid sequence of a linker as listed the same row of Table 1, A1, A5, D1-D12, T1, or T2, or a sequence having at least 70%, 75%, 80%, 85%, 90%, 95%, 97%, 98%, or 99% identity thereto.

102. The gene modifying polypeptide of embodiment 40, wherein the RT domain comprises one or more (e.g., at least 1, 2, 3, 4, 5, 6, 7, 8, 9, 10, 11, 12, 13, 14, 15, 16, 17, 18, 19, or 20) amino acid substitutions at a residue corresponding to position 200, 603, 330, 524, 562, 583, 51, 67, 67, 197, 204, 302, 309, 313, 435, 454, 594, 671, 69, or 653 of an MLVMS RT domain sequence as described herein (e.g., as listed in Table 6), e.g., an MLVMS_reference sequence, e.g., SEQ ID NO: 8137, relative to a wildtype sequence of the RT domain.

103. The gene modifying polypeptide of embodiment 40, wherein the RT domain comprises an RT domain comprising an amino acid sequence of an MLVMS RT domain sequence as described herein (e.g., as listed in Table 6), e.g., an MLVMS_reference sequence, e.g., SEQ ID NO: 8137, or a sequence having at least 70%, 75%, 80%, 85%, 90%, 95%, 97%, 98%, or 99% identity thereto.

104. The gene modifying polypeptide of embodiment 40, wherein the RT domain comprises one or more (e.g., at least 1, 2, 3, 4, 5, 6, 7, 8, 9, 10, 11, 12, 13, 14, 15, 16, 17, 18, 19, or 20) amino acid substitutions at a residue corresponding to position 200, 603, 330, 524, 562, 583, 51, 67, 67, 197, 204, 302, 309, 313, 435, 454, 594, 671, 69, or 653 of an MLVMS RT domain sequence as described herein (e.g., as listed in Table 6), e.g., an MLVMS_P03355 sequence, e.g., SEQ ID NO: 8070, relative to a wildtype sequence of the RT domain.

105. The gene modifying polypeptide of embodiment 40, wherein the RT domain comprises an RT domain comprising an amino acid sequence of an MLVMS RT domain sequence as described herein (e.g., as listed in Table 6), e.g., an MLVMS_P03355 sequence, e.g., SEQ ID NO: 8070, or a sequence having at least 70%, 75%, 80%, 85%, 90%, 95%, 97%, 98%, or 99% identity thereto.

106. The gene modifying polypeptide of embodiment 40, wherein the RT domain comprises an RT domain comprising an amino acid sequence of an AVIRE RT domain sequence as described herein (e.g., as listed in Table 6), e.g., an AVIRE_P03360 sequence, e.g., SEQ ID NO: 8001, or a sequence having at least 70%, 75%, 80%, 85%, 90%, 95%, 97%, 98%, or 99% identity thereto.

107. The gene modifying polypeptide of embodiment 40, wherein the RT domain comprises an RT domain comprising an amino acid sequence of an BAEVM RT domain sequence as described herein (e.g., as listed in Table 6), e.g., an BAEVM_P10272 sequence, e.g., SEQ ID NO: 8004, or a sequence having at least 70%, 75%, 80%, 85%, 90%, 95%, 97%, 98%, or 99% identity thereto.

108. The gene modifying polypeptide of embodiment 40, wherein the RT domain comprises an RT domain comprising an amino acid sequence of an BLVAU RT domain sequence as described herein (e.g., as listed in Table 6), e.g., an BLVAU_P25059 sequence, e.g., SEQ ID NO: 8007, or a sequence having at least 70%, 75%, 80%, 85%, 90%, 95%, 97%, 98%, or 99% identity thereto.

109. The gene modifying polypeptide of embodiment 40, wherein the RT domain comprises an RT domain comprising an amino acid sequence of an BLVJ RT domain sequence as described herein (e.g., as listed in Table 6), e.g., an BLVJ_P03361 sequence, e.g., SEQ ID NO: 8009, or a sequence having at least 70%, 75%, 80%, 85%, 90%, 95%, 97%, 98%, or 99% identity thereto.

110. The gene modifying polypeptide of embodiment 40, wherein the RT domain comprises an RT domain comprising an amino acid sequence of an FFV RT domain sequence as described herein (e.g., as listed in Table 6), e.g., an FFV_O93209 sequence, e.g., SEQ ID NO: 8012, or a sequence having at least 70%, 75%, 80%, 85%, 90%, 95%, 97%, 98%, or 99% identity thereto.

111. The gene modifying polypeptide of embodiment 40, wherein the RT domain comprises an RT domain comprising an amino acid sequence of an FLV RT domain sequence as described herein (e.g., as listed in Table 6), e.g., an FLV_P10273 sequence, e.g., SEQ ID NO: 8019, or a sequence having at least 70%, 75%, 80%, 85%, 90%, 95%, 97%, 98%, or 99% identity thereto.

112. The gene modifying polypeptide of embodiment 40, wherein the RT domain comprises an RT domain comprising an amino acid sequence of an FOAMV RT domain sequence as described herein (e.g., as listed in Table 6), e.g., an FOAMV_P14350 sequence, e.g., SEQ ID NO: 8021, or a sequence having at least 70%, 75%, 80%, 85%, 90%, 95%, 97%, 98%, or 99% identity thereto.

113. The gene modifying polypeptide of embodiment 40, wherein the RT domain comprises an RT domain comprising an amino acid sequence of an GALV RT domain sequence as described herein (e.g., as listed in Table 6), e.g., an GALV_P21414 sequence, e.g., SEQ ID NO: 8027, or a sequence having at least 70%, 75%, 80%, 85%, 90%, 95%, 97%, 98%, or 99% identity thereto.

114. The gene modifying polypeptide of embodiment 40, wherein the RT domain comprises an RT domain comprising an amino acid sequence of an HTL1A RT domain sequence as described herein (e.g., as listed in Table 6), e.g., an HTL1A_P03362 sequence, e.g., SEQ ID NO: 8030, or a sequence having at least 70%, 75%, 80%, 85%, 90%, 95%, 97%, 98%, or 99% identity thereto.

115. The gene modifying polypeptide of embodiment 40, wherein the RT domain comprises an RT domain comprising an amino acid sequence of an HTL1C RT domain sequence as described herein (e.g., as listed in Table 6), e.g., an HTL1C_P14078 sequence, e.g., SEQ ID NO: 8033, or a sequence having at least 70%, 75%, 80%, 85%, 90%, 95%, 97%, 98%, or 99% identity thereto.

116. The gene modifying polypeptide of embodiment 40, wherein the RT domain comprises an RT domain comprising an amino acid sequence of an HTL32 RT domain sequence as described herein (e.g., as listed in Table 6), e.g., an HTL32_Q0R5R2 sequence, e.g., SEQ ID NO: 8038, or a sequence having at least 70%, 75%, 80%, 85%, 90%, 95%, 97%, 98%, or 99% identity thereto.

117. The gene modifying polypeptide of embodiment 40, wherein the RT domain comprises an RT domain comprising an amino acid sequence of an HTL3P RT domain sequence as described herein (e.g., as listed in Table 6), e.g., an HTL3P_Q4U0X6 sequence, e.g., SEQ ID NO: 8041, or a sequence having at least 70%, 75%, 80%, 85%, 90%, 95%, 97%, 98%, or 99% identity thereto.

118. The gene modifying polypeptide of embodiment 40, wherein the RT domain comprises an RT domain comprising an amino acid sequence of an JSRV RT domain sequence as described herein (e.g., as listed in Table 6), e.g., an JSRV_P31623 sequence, e.g., SEQ ID NO: 8045, or a sequence having at least 70%, 75%, 80%, 85%, 90%, 95%, 97%, 98%, or 99% identity thereto.

119. The gene modifying polypeptide of embodiment 40, wherein the RT domain comprises an RT domain comprising an amino acid sequence of an KORV RT domain sequence as described herein (e.g., as listed in Table 6), e.g., an KORV_Q9TTC1 sequence, e.g., SEQ ID NO: 8047, or a sequence having at least 70%, 75%, 80%, 85%, 90%, 95%, 97%, 98%, or 99% identity thereto.

120. The gene modifying polypeptide of embodiment 40, wherein the RT domain comprises an RT domain comprising an amino acid sequence of an MLVAV RT domain sequence as described herein (e.g., as listed in Table 6), e.g., an MLVAV_P03356 sequence, e.g., SEQ ID NO: 8053, or a sequence having at least 70%, 75%, 80%, 85%, 90%, 95%, 97%, 98%, or 99% identity thereto.

121. The gene modifying polypeptide of embodiment 40, wherein the RT domain comprises an RT domain comprising an amino acid sequence of an MLVBM RT domain sequence as described herein (e.g., as listed in Table 6), e.g., an MLVBM_Q7SVK7 sequence, e.g., SEQ ID NO: 8056, or a sequence having at least 70%, 75%, 80%, 85%, 90%, 95%, 97%, 98%, or 99% identity thereto.

122. The gene modifying polypeptide of embodiment 40, wherein the RT domain comprises an RT domain comprising an amino acid sequence of an MLVCB RT domain sequence as described herein (e.g., as listed in Table 6), e.g., an MLVCB_P08361 sequence, e.g., SEQ ID NO: 8062, or a sequence having at least 70%, 75%, 80%, 85%, 90%, 95%, 97%, 98%, or 99% identity thereto.

123. The gene modifying polypeptide of embodiment 40, wherein the RT domain comprises an RT domain comprising an amino acid sequence of an MLVF5 RT domain sequence as described herein (e.g., as listed in Table 6), e.g., an MLVF5_P26810 sequence, e.g., SEQ ID NO: 8065, or a sequence having at least 70%, 75%, 80%, 85%, 90%, 95%, 97%, 98%, or 99% identity thereto.

124. The gene modifying polypeptide of embodiment 40, wherein the RT domain comprises an RT domain comprising an amino acid sequence of an MLVRD RT domain sequence as described herein (e.g., as listed in Table 6), e.g., an MLVRD_P11227 sequence, e.g., SEQ ID NO: 8078, or a sequence having at least 70%, 75%, 80%, 85%, 90%, 95%, 97%, 98%, or 99% identity thereto.

125. The gene modifying polypeptide of embodiment 40, wherein the RT domain comprises an RT domain comprising an amino acid sequence of an MMTVB RT domain sequence as described herein (e.g., as listed in Table 6), e.g., an MMTVB_P03365 sequence, e.g., SEQ ID NO: 8080, or a sequence having at least 70%, 75%, 80%, 85%, 90%, 95%, 97%, 98%, or 99% identity thereto.

126. The gene modifying polypeptide of embodiment 40, wherein the RT domain comprises an RT domain comprising an amino acid sequence of an MPMV RT domain sequence as described herein (e.g., as listed in Table 6), e.g., an MPMV_P07572 sequence, e.g., SEQ ID NO: 8097, or a sequence having at least 70%, 75%, 80%, 85%, 90%, 95%, 97%, 98%, or 99% identity thereto.

127. The gene modifying polypeptide of embodiment 40, wherein the RT domain comprises an RT domain comprising an amino acid sequence of an PERV RT domain sequence as described herein (e.g., as listed in Table 6), e.g., an PERV_Q4VFZ2 sequence, e.g., SEQ ID NO: 8099, or a sequence having at least 70%, 75%, 80%, 85%, 90%, 95%, 97%, 98%, or 99% identity thereto.

128. The gene modifying polypeptide of embodiment 40, wherein the RT domain comprises an RT domain comprising an amino acid sequence of an SFV1 RT domain sequence as described herein (e.g., as listed in Table 6), e.g., an SFV1_P23074 sequence, e.g., SEQ ID NO: 8105, or a sequence having at least 70%, 75%, 80%, 85%, 90%, 95%, 97%, 98%, or 99% identity thereto.

129. The gene modifying polypeptide of embodiment 40, wherein the RT domain comprises an RT domain comprising an amino acid sequence of an SFV3L RT domain sequence as described herein (e.g., as listed in Table 6), e.g., an SFV3L_P27401 sequence, e.g., SEQ ID NO: 8111, or a sequence having at least 70%, 75%, 80%, 85%, 90%, 95%, 97%, 98%, or 99% identity thereto.

130. The gene modifying polypeptide of embodiment 40, wherein the RT domain comprises an RT domain comprising an amino acid sequence of an SFVCP RT domain sequence as described herein (e.g., as listed in Table 6), e.g., an SFVCP Q87040 sequence, e.g., SEQ ID NO: 8117, or a sequence having at least 70%, 75%, 80%, 85%, 90%, 95%, 97%, 98%, or 99% identity thereto.

131. The gene modifying polypeptide of embodiment 40, wherein the RT domain comprises an RT domain comprising an amino acid sequence of an SMRV RT domain sequence as described herein (e.g., as listed in Table 6), e.g., an SMRVH_P03364 sequence, e.g., SEQ ID NO: 8123, or a sequence having at least 70%, 75%, 80%, 85%, 90%, 95%, 97%, 98%, or 99% identity thereto.

132. The gene modifying polypeptide of embodiment 40, wherein the RT domain comprises an RT domain comprising an amino acid sequence of an SRV2 RT domain sequence as described herein (e.g., as listed in Table 6), e.g., an SRV2_P51517 sequence, e.g., SEQ ID NO: 8126, or a sequence having at least 70%, 75%, 80%, 85%, 90%, 95%, 97%, 98%, or 99% identity thereto.

133. The gene modifying polypeptide of embodiment 40, wherein the RT domain comprises an RT domain comprising an amino acid sequence of an WDSV RT domain sequence as described herein (e.g., as listed in Table 6), e.g., an WDSV_O92815 sequence, e.g., SEQ ID NO: 8128, or a sequence having at least 70%, 75%, 80%, 85%, 90%, 95%, 97%, 98%, or 99% identity thereto.

134. The gene modifying polypeptide of embodiment 40, wherein the RT domain comprises an RT domain comprising an amino acid sequence of an WMSV RT domain sequence as described herein (e.g., as listed in Table 6), e.g., an WMSV_P03359 sequence, e.g., SEQ ID NO: 8131, or a sequence having at least 70%, 75%, 80%, 85%, 90%, 95%, 97%, 98%, or 99% identity thereto.

135. The gene modifying polypeptide of embodiment 40, wherein the RT domain comprises an RT domain comprising an amino acid sequence of an XMRV6 RT domain sequence as described herein (e.g., as listed in Table 6), e.g., an XMRV6_A1Z651 sequence, e.g., SEQ ID NO: 8134, or a sequence having at least 70%, 75%, 80%, 85%, 90%, 95%, 97%, 98%, or 99% identity thereto.

136. The gene modifying polypeptide of any one of embodiments 40-135, wherein the RT domain comprises:
   a) the amino acid asparagine (N) at position 200 of SEQ ID NO: 8137 or at a corresponding position in a homologous RT domain;
   b) the amino acid tryptophan (W) at position 603 of SEQ ID NO: 8137 or at a corresponding position in a homologous RT domain;
   c) the amino acid proline (P) at position 330 of SEQ ID NO: 8137 or at a corresponding position in a homologous RT domain;
   d) the amino acid glycine (G) at position 524 of SEQ ID NO: 8137 or at a corresponding position in a homologous RT domain;
   e) the amino acid glutamine (Q) at position 562 of SEQ ID NO: 8137 or at a corresponding position in a homologous RT domain;
   f) the amino acid asparagine (N) at position 583 of SEQ ID NO: 8137 or at a corresponding position in a homologous RT domain;
   g) the amino acid leucine (L) at position 51 of SEQ ID NO: 8137 or at a corresponding position in a homologous RT domain;
   h) the amino acid arginine (R) at position 67 of SEQ ID NO: 8137 or at a corresponding position in a homologous RT domain;
   i) the amino acid lysine (K) at position 67 of SEQ ID NO: 8137 or at a corresponding position in a homologous RT domain;
   j) the amino acid alanine (A) at position 197 of SEQ ID NO: 8137 or at a corresponding position in a homologous RT domain;
   k) the amino acid arginine (R) at position 204 of SEQ ID NO: 8137 or at a corresponding position in a homologous RT domain;
   l) the amino acid lysine (K) at position 302 of SEQ ID NO: 8137 or at a corresponding position in a homologous RT domain;
   m) the amino acid asparagine (N) at position 309 of SEQ ID NO: 8137 or at a corresponding position in a homologous RT domain;
   n) the amino acid phenylalanine (F) at position 313 of SEQ ID NO: 8137 or at a corresponding position in a homologous RT domain;
   o) the amino acid glycine (G) at position 435 of SEQ ID NO: 8137 or at a corresponding position in a homologous RT domain;
   p) the amino acid lysine (K) at position 454 of SEQ ID NO: 8137 or at a corresponding position in a homologous RT domain;
   q) the amino acid glutamine (Q) at position 594 of SEQ ID NO: 8137 or at a corresponding position in a homologous RT domain;
   r) the amino acid proline (P) at position 671 of SEQ ID NO: 8137 or at a corresponding position in a homologous RT domain;
   s) the amino acid lysine (K) at position 69 of SEQ ID NO: 8137 or at a corresponding position in a homologous RT domain; or
   t) the amino acid asparagine (N) at position 653 of SEQ ID NO: 8137 or at a corresponding position in a homologous RT domain.

137. The gene modifying polypeptide of embodiment 40, wherein the RT domain has a sequence with at least 90% identity to the RT domain of the reference gene modifying polypeptide.

138. The gene modifying polypeptide of any of the preceding embodiments, wherein the RT domain has a sequence with at least 95% identity to the RT domain of the reference gene modifying polypeptide.

139. The gene modifying polypeptide of any of the preceding embodiments, wherein the RT domain has a sequence with at least 98% identity to the RT domain of the reference gene modifying polypeptide.

140. The gene modifying polypeptide of any of the preceding embodiments, wherein the RT domain has a sequence with at least 99% identity to the RT domain of the reference gene modifying polypeptide.

141. The gene modifying polypeptide of any of the preceding embodiments, wherein the RT domain has a sequence with 100% identity to the RT domain of the reference gene modifying polypeptide.

142. The gene modifying polypeptide of any of the preceding embodiments, wherein the linker has a sequence with at least 90% identity to the linker sequence from the reference gene modifying polypeptide.

143. The gene modifying polypeptide of any of the preceding embodiments, wherein the linker has a sequence with at least 95% identity to the linker sequence from the reference gene modifying polypeptide.

144. The gene modifying polypeptide of any of the preceding embodiments, wherein the linker has a sequence with at least 97% identity to the linker sequence from the reference gene modifying polypeptide.

145. The gene modifying polypeptide of any of the preceding embodiments, wherein the linker has a sequence with 100% identity to the linker sequence from the reference gene modifying polypeptide.

146. The gene modifying polypeptide of any of the preceding embodiments, wherein the linker has an amino acid sequence with at least 80%, 85%, 90%, 95%, 97%, or 100% identity to SEQ ID NO: 11,041.

147. The gene modifying polypeptide of any of the preceding embodiments, wherein the RT domain comprises a mutation as listed in Table 2.

148. The gene modifying polypeptide of any of the preceding embodiments, wherein the RT domain comprises one or more (e.g., 1, 2, 3, 4, 5, or 6) mutations as listed in any single row of Table 2.

149. The gene modifying polypeptide of any of the preceding embodiments, wherein the RT domain comprises all of the mutations listed in any single row of Table 2.

150. The gene modifying polypeptide of any of the preceding embodiments, wherein the Cas domain comprises a sequence of Table 7 or 8, or a sequence having at least 70%, 75%, 80%, 85%, 90%, 95%, 98%, or 99% identity thereto.

151. The gene modifying polypeptide of any of the preceding embodiments, wherein the Cas domain comprises the amino acid sequence of a Cas domain comprised in the amino acid sequence of the reference gene modifying polypeptide, or a sequence having at least 70%, 75%, 80%, 85%, 90%, 95%, 98%, or 99% identity thereto.

152. The gene modifying polypeptide of any of the preceding embodiments, wherein the Cas domain does not comprise the amino acid sequence of a Cas domain comprised in the amino acid sequence of the reference gene modifying polypeptide, or a sequence having at least 70%, 75%, 80%, 85%, 90%, 95%, 98%, or 99% identity thereto.

153. The gene modifying polypeptide of any of the preceding embodiments, wherein the Cas domain is a Cas nickase domain.

154. The gene modifying polypeptide of any of the preceding embodiments, wherein the Cas domain is a Cas9 nickase domain.

155. The gene modifying polypeptide of any of the preceding embodiments, wherein the Cas domain comprises an N863A mutation.

156. The gene modifying polypeptide of any of the preceding embodiments, which comprises an NLS, e.g., wherein the gene modifying polypeptide comprises two NLSs.

157. The gene modifying polypeptide of any of the preceding embodiments, which comprises an NLS N-terminal of the Cas9 domain.

158. The gene modifying polypeptide of any of the preceding embodiments, which comprises an NLS C-terminal of the RT domain.

159. The gene modifying polypeptide of any of the preceding embodiments, which comprises a first NLS which is N-terminal of the Cas9 domain and a second NLS which is C-terminal of the RT domain.

160. The gene modifying polypeptide of any of the preceding embodiments, which comprises a sequence of SEQ ID NO: 4000 which comprises the first NLS and the Cas domain, or a sequence having at least 70%, 75%, 80%, 85%, 90%, 95%, 98%, or 99% identity thereto.

161. The gene modifying polypeptide of any of the preceding embodiments, which comprises a sequence of SEQ ID NO: 4001 which comprises the second NLS, or a sequence having at least 70%, 75%, 80%, 85%, 90%, 95%, 98%, or 99% identity thereto.

162. The gene modifying polypeptide of any of the preceding embodiments, which comprises a GG amino acid sequence between the Cas domain and the linker.

163. The gene modifying polypeptide of any of the preceding embodiments, which comprises an AG amino acid sequence between the RT domain and the second NLS.

164. The gene modifying polypeptide of any of the preceding embodiments, which comprises a GG amino acid sequence between the linker and the RT domain.

165. The gene modifying polypeptide of any of the preceding embodiments, which produces an increase in converted GFP+ of at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% relative to unsorted input cells in an assay of Example 2 using HEK cells and g4 guide RNA.

166. A gene modifying polypeptide comprising:
a Cas domain (e.g., a Cas nickase domain, e.g., a Cas9 nickase domain);
a reverse transcriptase (RT) domain comprising an amino acid sequence of an RT domain provided in any one of SEQ ID NOs: 1-7743, or a sequence having at least 70%, 75%, 80%, 85%, 90%, 95%, 97%, 98%, or 99% identity thereto; and
a linker disposed between the RT domain and the Cas domain comprising an amino acid sequence of a linker as listed in Table 10, or a sequence having at least 70%, 75%, 80%, 85%, 90%, 95%, 97%, 98%, or 99% identity thereto,
wherein the amino acid sequences of the RT domain and the linker are provided in the same amino acid sequence of any one of SEQ ID NOs: 1-7743, which produces an increase in converted GFP+ of at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% relative to unsorted input cells in an assay of Example 2 using HEK cells and g4 guide RNA.

167. The gene modifying polypeptide of any of the preceding embodiments, which has an activity that is at least 50%, 60%, 70%, 80%, or 90% of the activity of a reference gene modifying polypeptide comprising, in an N-terminal to C-terminal direction:
a) an NLS and Cas domain sequence of SEQ ID NO: 4000;
b) a linker having the sequence EAAAKGSS (SEQ ID NO: 5152);
c) an RT domain having the sequence of PERV_Q4VFZ2_3mutA_WS; and
d) an NLS sequence of SEQ ID NO: 4001,
in an assay of Example 1 using HEK cells and g4 guide RNA.

168. The gene modifying polypeptide of any of the preceding embodiments, which has an activity that is at least 10%, 20%, 30%, 40%, 50%, 60%, 70%, 75%, 80%, 85%, 90%, 95%, 100%, 125%, 150%, 175%, 200%, 250%, 300%, 400%, 500%, 600%, 700%, 800%, 900%, 1000%, 1500%, 2000%, or 2500% greater than the activity of a reference gene modifying polypeptide comprising a sequence of SEQ ID NO: 4002, e.g., in an assay of Example 1 using HEK cells and g4 guide RNA.

169. A nucleic acid (e.g., DNA or RNA, e.g., mRNA) encoding the gene modifying polypeptide of any of the preceding embodiments.

170. A cell comprising the gene modifying polypeptide of any of embodiments 40-68 or the nucleic acid of embodiment 169.

171. A system comprising:
i) the gene modifying polypeptide of any of embodiments 40-68, and
ii) a template RNA that comprises:
a) a gRNA spacer that is complementary to a portion a target nucleic acid sequence;
b) a gRNA scaffold that binds the Cas domain of the gene modifying polypeptide;
c) a heterologous object sequence; and
d) a primer binding site sequence (PBS sequence).

172. A method for modifying a target nucleic acid in a cell (e.g., a human cell), the method comprising contacting the cell with the system of embodiment 171, or nucleic acid encoding the same, thereby modifying the target nucleic acid.

173. A gene modifying polypeptide comprising:
a Cas domain (e.g., a Cas nickase domain, e.g., a Cas9 nickase domain);
a reverse transcriptase (RT) domain having one or more (e.g., at least 1, 2, 3, 4, 5, 6, 7, 8, 9, 10, 11, 12, 13, 14, 15, 16, 17, 18, 19, or 20) amino acid substitutions at a residue corresponding to (e.g., at a residue at a homologous position relative to) position 200, 603, 330, 524, 562, 583, 51, 67, 67, 197, 204, 302, 309, 313, 435, 454, 594, 671, 69, or 653 of an MLVMS RT domain sequence as described herein (e.g., as listed in Table 6), e.g., an MLVMS_reference sequence, e.g., SEQ ID NO: 8137 relative to a wildtype sequence of the RT domain, wherein the RT domain is C-terminal of the Cas domain; and a linker disposed between the RT domain and the Cas domain, wherein the linker has a sequence from the same row of Table 1 as the RT domain, or a sequence having at least 70%, 75%, 80%, 85%, 90%, 95%, 97%, 98%, or 99% identity thereto.

174. A gene modifying polypeptide comprising:
a reverse transcriptase (RT) domain of an AVIRE RT, or an amino acid sequence having at least 70%, 75%, 80%, 85%, 90%, 95%, 96%, 97%, 98%, or 99% identity thereto;
a Cas nickase domain, wherein the RT domain is C-terminal of the Cas domain; and
a linker disposed between the Cas nickase domain and the RT domain, wherein the linker comprises an amino acid sequence as listed in Table 10, or an amino acid sequence having at least 70%, 75%, 80%, 85%, 90%, 95%, 96%, 97%, 98%, or 99% identity thereto.

175. A gene modifying polypeptide comprising:
a reverse transcriptase (RT) domain comprising the RT domain of a reference gene modifying polypeptide having sequence of any one of SEQ ID NO: 1, 2, 3, 4, 5, 6, 7, 9, 10, 12, 13, 14, 6076, 6143, 6200, 6254, 6274, 6315, 6328, 6337, 6403, 6420, 6440, 6513, 6552, 6613, 6671, 6822, 6840, 6884, 6907, 6970, 7025, 7052, 7078, 7243, 7253, 7318, 7379, 7486, 7524, 7668, 7680, 7720, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 6015, 6029, 6045, 6077, 6129, 6144, 6164, 6201, 6227, 6244, 6250, 6264, 6289, 6304, 6316, 6384, 6421, 6441, 6492, 6514, 6530, 6569, 6584, 6621, 6651, 6659, 6683, 6703, 6727, 6732, 6745, 6755, 6784, 6817, 6823, 6841, 6871, 6885, 6898, 6908, 6933, 6971, 7009, 7018, 7045, 7053, 7068, 7079, 7096, 7104, 7122, 7151, 7163, 7181, 7244, 7273, 7319, 7336, 7380, 7402, 7462, 7487, 7525, 7569, 7626, 7689, 7707, 7721, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1439, 1440, 1441, 1442, 1443, 1444, 1445, 1446, 1447, 6001, 6030, 6078, 6108, 6130, 6165, 6265, 6275, 6305, 6329, 6370, 6385, 6404, 6531, 6585, 6622, 6652, 6733, 6756, 6765, 6798, 6824, 6972, 7046, 7054, 7069, 7080, 7105, 7123, 7143, 7152, 7204, 7320, 7351, 7381, 7403, 7438, 7488, 7500, 7526, 7588, 7612, 7627 or a sequence having at least 70%, 75%, 80%, 85%, 90%, 95%, 97%, 98%, or 99% identity thereto;
a Cas nickase domain, wherein the RT domain is C-terminal of the Cas domain; and
a linker disposed between the Cas nickase domain and the RT domain, wherein the linker comprises the linker of said reference gene modifying polypeptide, or a sequence having at least 70%, 75%, 80%, 85%, 90%, 95%, 97%, 98%, or 99% identity thereto.

176. A gene modifying polypeptide comprising:
a reverse transcriptase (RT) domain having the sequence of SEQ ID NO: 8001, 8002, or 8003, or a sequence having at least 70%, 75%, 80%, 85%, 90%, 95%, 97%, 98%, or 99% identity thereto;
a Cas nickase domain, wherein the RT domain is C-terminal of the Cas nickase domain; and
a linker disposed between the RT domain and the Cas nickase domain, wherein the linker comprises an amino acid sequence of the linker of any of SEQ ID NOS: a reference gene modifying polypeptide having sequence of any one of SEQ ID NO: 1, 2, 3, 4, 5, 6, 7, 9, 10, 12, 13, 14, 6076, 6143, 6200, 6254, 6274, 6315, 6328, 6337, 6403, 6420, 6440, 6513, 6552, 6613, 6671, 6822, 6840, 6884, 6907, 6970, 7025, 7052, 7078, 7243, 7253, 7318, 7379, 7486, 7524, 7668, 7680, 7720, 1137, 1138, 1139, 1140, 1141, 1142, 1143, 1144, 1145, 1146, 1147, 1148, 1149, 1150, 1151, 1152, 1153, 1154, 1155, 1156, 1157, 1158, 1159, 1160, 1161, 1162, 1163, 1164, 1165, 1166, 1167, 6015, 6029, 6045, 6077, 6129, 6144, 6164, 6201, 6227, 6244, 6250, 6264, 6289, 6304, 6316, 6384, 6421, 6441, 6492, 6514, 6530, 6569, 6584, 6621, 6651, 6659, 6683, 6703, 6727, 6732, 6745, 6755, 6784, 6817, 6823, 6841, 6871, 6885, 6898, 6908, 6933, 6971, 7009, 7018, 7045, 7053, 7068, 7079, 7096, 7104, 7122, 7151, 7163, 7181, 7244, 7273, 7319, 7336, 7380, 7402, 7462, 7487, 7525, 7569, 7626, 7689, 7707, 7721, 1371, 1372, 1373, 1374, 1375, 1376, 1377, 1378, 1379, 1380, 1381, 1382, 1383, 1384, 1385, 1386, 1387, 1388, 1389, 1390, 1391, 1392, 1393, 1394, 1395, 1396, 1397, 1398, 1399, 1400, 1401, 1402, 1403, 1404, 1405, 1406, 1407, 1408, 1409, 1410, 1411, 1412, 1413, 1414, 1415, 1416, 1417, 1418, 1419, 1420, 1421, 1422, 1423, 1424, 1425, 1426, 1427, 1428, 1429, 1430, 1431, 1432, 1433, 1434, 1435, 1436, 1437, 1439, 1440, 1441, 1442, 1443, 1444, 1445, 1446, 1447, 6001, 6030, 6078, 6108, 6130, 6165, 6265, 6275, 6305, 6329, 6370, 6385, 6404, 6531, 6585, 6622, 6652, 6733, 6756, 6765, 6798, 6824, 6972, 7046, 7054, 7069, 7080, 7105, 7123, 7143, 7152, 7204, 7320, 7351, 7381, 7403, 7438, 7488, 7500, 7526, 7588, 7612, 7627, or a sequence having at least 70%, 75%, 80%, 85%, 90%, 95%, 97%, 98%, or 99% identity thereto.

177. The gene modifying polypeptide of any of embodiments 174-176, wherein the RT domain comprises a mutation at one or more of positions 8, 51, 67, 69, 197, 200, 204, 302, 306, 309, 313, 330, 436, 455, 526, 564, 585, 596, 605, 655, 673 relative to a reference RT domain having sequence of SEQ ID NO:8001.

178. The gene modifying polypeptide of any of embodiments 174-177, wherein the RT domain comprises one or more of the following mutations: Q51L, T67R, E67K, E69K, T197A, D200N, N204R, E302K, Y309N, W313F, G330P, T436G, N455K, D526G, E564Q, D585N, H596Q, L605W, D655N, L673P 179. The gene modifying polypeptide of embodiment 178, wherein the RT domain comprises the following mutations: (a) D200N, G330P, and L605W or (b) D200N, G330P, L605W, T306K, and W313F.

180. The gene modifying polypeptide of any of embodiments 174-179, said polypeptide comprising a linker having a sequence of any one of SEQ ID NO: 11,041-11,050.

181. A gene modifying polypeptide comprising:
a reverse transcriptase (RT) domain having the sequence of SEQ ID NO: 8,003, or a sequence having at least 95% identity thereto;
a Cas nickase domain, wherein the RT domain is C-terminal of the Cas nickase domain; and
a linker disposed between the RT domain and the Cas nickase domain, wherein the linker comprises an amino acid sequence according to SEQ ID NO: 5217 or 15,401.

182. A gene modifying polypeptide comprising:
a reverse transcriptase (RT) domain having the sequence of SEQ ID NO: 8,020, or a sequence having at least 95% identity thereto;
a Cas nickase domain, wherein the RT domain is C-terminal of the Cas nickase domain; and
a linker disposed between the RT domain and the Cas nickase domain, wherein the linker comprises an amino acid sequence according to SEQ ID NO: 5217 or 15,402.

183. A gene modifying polypeptide comprising:
a reverse transcriptase (RT) domain having the sequence of SEQ ID NO: 8,074, or a sequence having at least 95% identity thereto;
a Cas nickase domain, wherein the RT domain is C-terminal of the Cas nickase domain; and
a linker disposed between the RT domain and the Cas nickase domain, wherein the linker comprises an amino acid sequence according to SEQ ID NO: 15,403.

184. A gene modifying polypeptide comprising:
a reverse transcriptase (RT) domain having the sequence of SEQ ID NO: 8,113, or a sequence having at least 95% identity thereto;
a Cas nickase domain, wherein the RT domain is C-terminal of the Cas nickase domain; and
a linker disposed between the RT domain and the Cas nickase domain, wherein the linker comprises an amino acid sequence according to SEQ ID NO: 15,404.

185. A gene modifying polypeptide comprising:
a reverse transcriptase (RT) domain comprising the RT domain of a reference gene modifying polypeptide having the sequence of any one of SEQ ID NOs: 1-7743; and
a Cas nickase domain, wherein the RT domain is C-terminal of the Cas nickase domain; and
a linker disposed between the RT domain and the Cas nickase domain, wherein the linker comprises the linker of said reference gene modifying polypeptide.

186. The gene modifying polypeptide of any of embodiments 174-185, which comprises a nuclear localization signal (NLS).

187. The gene modifying polypeptide of any of embodiments 174-186, which comprises a first NLS which is N-terminal of the Cas nickase domain.

188. The gene modifying polypeptide of any of embodiments 174-187, which comprises an NLS which is C-terminal of the RT domain.

189. The gene modifying polypeptide of any of embodiments 174-188, which comprises a first NLS which is N-terminal of the Cas nickase domain and a second NLS which is C-terminal of the RT domain.

190. The gene modifying polypeptide of any of embodiments 174-189, which comprises a first NLS which is N-terminal of the Cas nickase domain, wherein the first NLS comprises an amino acid sequence of PAAKRVKLD (SEQ ID NO: 11,095).

191. The gene modifying polypeptide of any of embodiments 174-190, which comprises an NLS which is C-terminal of the RT domain and has an amino acid sequence of KRTADGSEFE (SEQ ID NO: 4650).

192. The gene modifying polypeptide of any of embodiments 174-191, which comprises an NLS which is C-terminal of the RT domain and has an amino acid sequence of KRTADGSEFESPKKKAKVE (SEQ ID NO: 4651).

193. The gene modifying polypeptide of any of embodiments 174-192, which comprises a sequence of SEQ ID NO: 4000 which comprises the first NLS and the Cas nickase domain.

194. The gene modifying polypeptide of any of embodiments 174-193, which comprises a sequence of SEQ ID NO: 4001 which comprises the second NLS.

195. The gene modifying polypeptide of any of embodiments 174-194, which comprises a GG amino acid sequence between the Cas nickase domain and the linker.

196. The gene modifying polypeptide of any of embodiments 174-195, which comprises an AG amino acid sequence between the RT domain and the second NLS.

197. The gene modifying polypeptide of any of embodiments 174-196, which comprises a GG amino acid sequence between the linker and the RT domain.

198. The gene modifying polypeptide of any of embodiments 174-197, wherein the Cas nickase domain comprises a Cas9 nickase domain.

199. The gene modifying polypeptide of any of embodiments 174-198, wherein the Cas nickase domain comprises an N863A mutation.

200. The gene modifying polypeptide of any of embodiments 174-199, wherein the Cas nickase comprises a sequence of SEQ ID NO: 11,096.

201. The gene modifying polypeptide of any of embodiments 174-200, wherein the Cas nickase comprises a sequence of any of SEQ ID NO: 9,001-9,037, 11,096, or a sequence having at least 70%, 75%, 80%, 85%, 90%, 95%, 97%, 98%, or 99% identity thereto.

202. The gene modifying polypeptide of any of embodiments 174-201, which comprises a methionine at the N-terminal position of the RT domain.

203. The gene modifying polypeptide of any of embodiments 174-202, which does not comprises a methionine at the N-terminal position of the RT domain.

204. The gene modifying polypeptide of any of embodiments 174-203, which comprises an amino acid sequence according to any of SEQ ID NOs: 1372, 1373, or 1410 or an amino acid sequence having at least 70%, 75%, 80%, 85%, 90%, 95%, 96%, 97%, 98%, or 99% identity thereto.

205. The gene modifying polypeptide of any of embodiments 174-204, which comprises an amino acid sequence according to SEQ ID NO: 2784 or an amino acid sequence having at least 70%, 75%, 80%, 85%, 90%, 95%, 96%, 97%, 98%, or 99% identity thereto.

206. The gene modifying polypeptide of any of embodiments 174-205, which comprises an amino acid sequence according to SEQ ID NO: 647 or an amino acid sequence having at least 70%, 75%, 80%, 85%, 90%, 95%, 96%, 97%, 98%, or 99% identity thereto.

207. The gene modifying polypeptide of any of embodiments 174-206, which comprises an amino acid sequence according to SEQ ID NO: 1197 or an amino acid sequence having at least 70%, 75%, 80%, 85%, 90%, 95%, 96%, 97%, 98%, or 99% identity thereto.

208. A nucleic acid molecule encoding the gene modifying polypeptide of any of embodiments 174-207.

209. The nucleic acid molecule of embodiment 208, which comprises RNA.

210. The nucleic acid molecule of embodiment 209, which comprises mRNA.

211. A cell comprising the gene modifying polypeptide of any of embodiments 174-207.

212. A cell comprising the nucleic acid molecule of any of embodiments 208-210.

213. A system comprising:
  i) the gene modifying polypeptide of any of embodiments 174-207, or a nucleic acid molecule encoding the gene modifying polypeptide, and
  ii) a template RNA that comprises:
    a) a gRNA spacer that is complementary to a portion a target nucleic acid sequence;
    b) a gRNA scaffold that binds the Cas nickase domain of the gene modifying polypeptide;
    c) a heterologous object sequence; and
    d) a primer binding site sequence.

214. A lipid nanoparticle formulation comprising the gene modifying polypeptide of any of embodiments 174-207, the nucleic acid of any of embodiments 208-210, or the system of embodiment 213.

215. A method for modifying a target nucleic acid molecule in a cell, the method comprising contacting the cell with the system of embodiment 213, thereby modifying the target nucleic acid molecule.

216. A method of using the gene modifying polypeptide of any of embodiments 174-207, the nucleic acid of any of embodiments 208-210, or the system of embodiment 213, to modify a target genome by target-primed reverse transcription, the method comprising contacting the target genome with the gene modifying polypeptide, nucleic acid, or system, thereby modifying the target nucleic acid molecule.

In one aspect, the disclosure relates to a system for modifying DNA, comprising (a) a nucleic acid encoding a gene modifying polypeptide capable of target primed reverse transcription, the polypeptide comprising (i) a reverse transcriptase domain and (ii) a Cas9 nickase that binds DNA and has endonuclease activity, and (b) a template RNA comprising (i) a gRNA spacer that is complementary to a first portion of a human gene, (ii) a gRNA scaffold that binds the polypeptide, (iii) a heterologous object sequence comprising a mutation region, and (iv) a primer binding site (PBS) sequence comprising at least 3, 4, 5, 6, 7, or 8 bases of 100% homology to a target DNA strand at the 3' end of the template RNA.

The gRNA spacer may comprise at least 15 bases of 100% homology to the target DNA at the 5' end of the template RNA. The template RNA may further comprise a PBS sequence comprising at least 5 bases of at least 80% homology to the target DNA strand. The template RNA may comprise one or more chemical modifications.

The domains of the gene modifying polypeptide may be joined by a peptide linker. The polypeptide may comprise one or more peptide linkers. The gene modifying polypeptide may further comprise a nuclear localization signal. The polypeptide may comprise more than one nuclear localization signal, e.g., multiple adjacent nuclear localization signals or one or more nuclear localization signals in different regions of the polypeptide, e.g., one or more nuclear localization signals in the N-terminus of the polypeptide and one or more nuclear localization signals in the C-terminus of the polypeptide. The nucleic acid encoding the gene modifying polypeptide may encode one or more intein domains.

Introduction of the system into a target cell may result in insertion of at least 1, 2, 3, 4, 5, 10, 15, 20, 25, 30, 35, 40, 45, 50, 60, 70, 80, 90, 100, 150, 200, 250, 300, 350, 400, 500, or 1000 base pairs of exogenous DNA. Introduction of the system into a target cell may result in deletion, wherein the deletion is less than 2, 3, 4, 5, 10, 50, or 100 base pairs of genomic DNA upstream or downstream of the insertion. Introduction of the system into a target cell may result in substitution, e.g., substitution of 1, 2, or 3 nucleotides, e.g., consecutive nucleotides.

The heterologous object sequence may be at least 5, 10, 25, 50, 100, 150, 200, 250, 300, 400, 500, 600, or 700 base pairs.

In one aspect, the disclosure relates to a pharmaceutical composition comprising the system described above and a pharmaceutically acceptable excipient or carrier, wherein the pharmaceutically acceptable excipient or carrier is selected from the group consisting of a plasmid vector, a viral vector, a vesicle, and a lipid nanoparticle. In one aspect, the disclosure relates to a pharmaceutical composition comprising the system described above and multiple pharmaceutically acceptable excipients or carriers, wherein the pharmaceutically acceptable excipients or carriers are selected from the group consisting of a plasmid vector, a viral vector, a vesicle, and a lipid nanoparticle, e.g., where the system described above is delivered by two distinct excipients or carriers, e.g., two lipid nanoparticles, two viral vectors, or one lipid nanoparticle and one viral vector. The viral vector may be an adeno-associated virus (AAV).

In one aspect, the disclosure relates to a host cell (e.g., a mammalian cell, e.g., a human cell) comprising the system described above.

The system may be introduced in vivo, in vitro, ex vivo, or in situ. The nucleic acid of (a) may be integrated into the genome of the host cell. In some embodiments, the nucleic acid of (a) is not integrated into the genome of the host cell. In some embodiments, the heterologous object sequence is inserted at only one target site in the host cell genome. The heterologous object sequence may be inserted at two or more target sites in the host cell genome, e.g., at the same corresponding site in two homologous chromosomes or at two different sites on the same or different chromosomes. The heterologous object sequence may encode a mammalian polypeptide, or a fragment or a variant thereof. The components of the system may be delivered on 1, 2, 3, 4, or more distinct nucleic acid molecules. The system may be introduced into a host cell by electroporation or by using at least one vehicle selected from a plasmid vector, a viral vector, a vesicle, and a lipid nanoparticle.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 2A is a schematic of the gene modifying polypeptide candidate, a fusion polypeptide comprising a nuclear localization signal (NLS), a *S. pyogenes* (Spy) Cas9 nickase containing an N863A mutation (Cas9n), a peptide linker selected from Table 10 (Linker), and a reverse transcriptase domain of retroviral origin selected from Table 6 (RT). FIG. 2B provides a schematic of the screen conducted with the pooled elements from the library of gene modifying polypeptide candidates.

FIG. 4A shows the editing activity of the two exemplary gene modifying polypeptides as assessed by percent of total cells converted to GFP-positive. FIG. 4B shows the editing activity of the two exemplary gene modifying polypeptides in the screen of Examples 2 and 3. FIG. 4C shows violin plots of the editing activities of all the exemplary gene modifying polypeptides comprising RT domains of the MLVMS RT family and of the MMTVB RT family.

FIG. 5A shows violin plots of enrichment after HEK293T cells were treated with the gene modifying polypeptide and exemplary template RNA g4. FIG. 5B shows violin plots of enrichment after U2OS cells were treated with the gene modifying polypeptide and exemplary template RNA g4. FIG. 5C shows violin plots of enrichment after HEK293T cells were treated with the gene modifying polypeptide and exemplary template RNA g10. FIG. 5D shows violin plots of enrichment after U2OS cells were treated with the gene modifying polypeptide and exemplary template RNA g10. FIG. 5E shows data for an additional replicate of the data presented in FIG. 5A, where HEK293T cells were treated with the gene modifying polypeptide and exemplary template RNA g4. FIG. 5F shows data for a further additional replicate of the data presented in FIG. 5A, where HEK293T cells were treated with the gene modifying polypeptide and exemplary template RNA g4. FIG. 5G shows violin plots combining the data of FIGS. 5A, 5E, and 5F, where HEK293T cells were treated with the gene modifying polypeptide and exemplary template RNA g4.

DETAILED DESCRIPTION

Definitions

Figure 1:
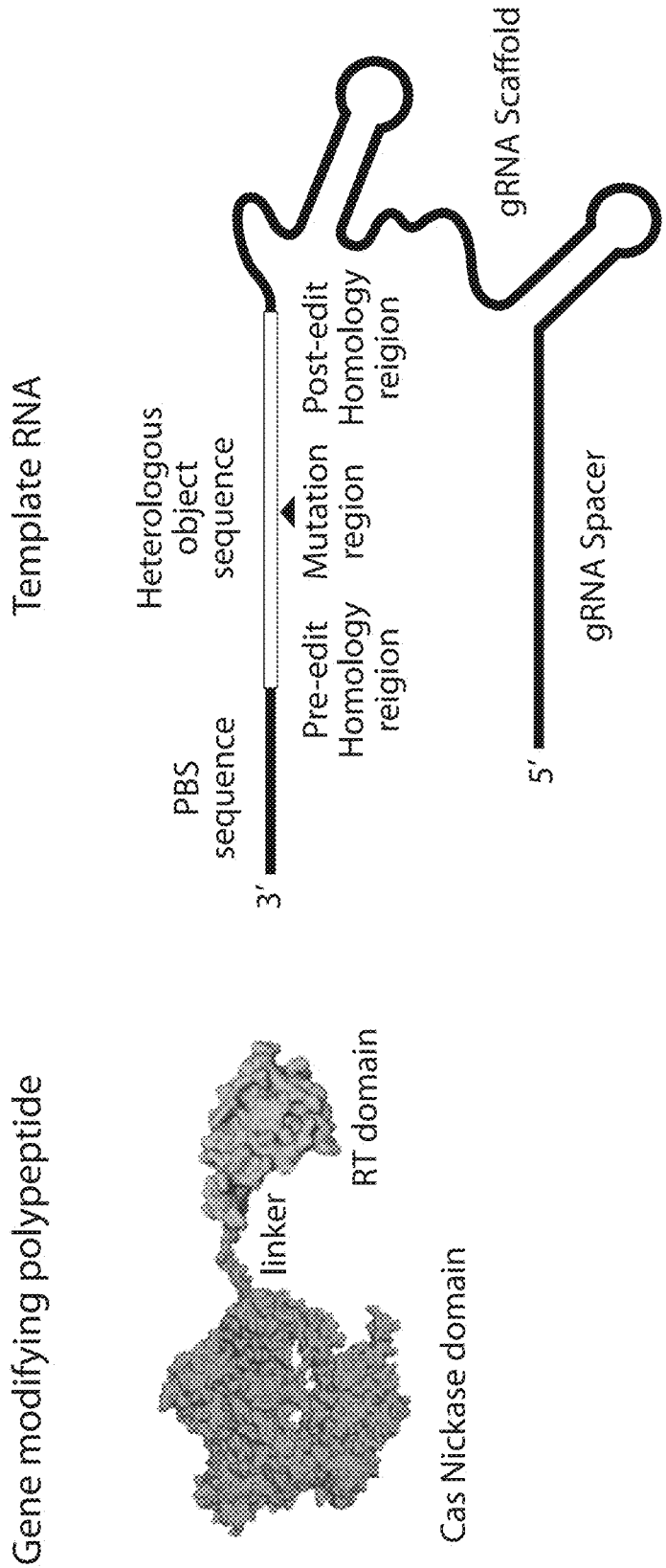
FIG. 1 depicts a gene modifying system as described herein. The left hand diagram shows the gene modifying polypeptide, which comprises a Cas nickase domain (e.g., spCas9 N863A) and a reverse transcriptase domain (RT domain) which are linked by a linker. The right hand diagram shows the template RNA which comprises, from 5' to 3', a gRNA spacer, a gRNA scaffold, a heterologous object sequence, and a primer binding site sequence (PBS sequence). The heterologous object sequence can comprise a mutation region that comprises one or more sequence differences relative to the target site. The heterologous object sequence can also comprise a pre-edit homology region and a post-edit homology region, which flank the mutation region. Without wishing to be bound by theory, it is thought that the gRNA spacer of the template RNA binds to the second strand of a target site in the genome, and the gRNA scaffold of the template RNA binds to the gene modifying polypeptide, e.g., localizing the gene modifying polypeptide to the target site in the genome. It is thought that the Cas domain of the gene modifying polypeptide nicks the target site (e.g., the first strand of the target site), e.g., allowing the PBS sequence to bind to a sequence adjacent to the site to be altered on the first strand of the target site. It is thought that the RT domain of the gene modifying polypeptide uses the first strand of the target site that is bound to the complementary sequence comprising the PBS sequence of the template RNA as a primer and the heterologous object sequence of the template RNA as a template to, e.g., polymerize a sequence complementary to the heterologous object sequence. Without wishing to be bound by theory, it is thought that reverse transcription can then proceed through the pre-edit homology region, then through the mutation region, and then through the post-edit homology region, thereby producing a DNA strand comprising a mutation specified by the heterologous object sequence.

The term "expression cassette," as used herein, refers to a nucleic acid construct comprising nucleic acid elements sufficient for the expression of the nucleic acid molecule of the instant invention.

A "gRNA spacer," as used herein, refers to a portion of a nucleic acid that has complementarity to a target nucleic acid and can, together with a gRNA scaffold, target a Cas protein to the target nucleic acid.

A "gRNA scaffold," as used herein, refers to a portion of a nucleic acid that can bind a Cas protein and can, together with a gRNA spacer, target the Cas protein to the target nucleic acid. In some embodiments, the gRNA scaffold comprises a crRNA sequence, tetraloop, and tracrRNA sequence.

A "gene modifying polypeptide," as used herein, refers to a polypeptide comprising a retroviral reverse transcriptase, or a polypeptide comprising an amino acid sequence having at least 75%, 80%, 85%, 90%, 95%, 96%, 97%, 98%, or 99% amino acid sequence identity to a retroviral reverse transcriptase, which is capable of integrating a nucleic acid sequence (e.g., a sequence provided on a template nucleic acid) into a target DNA molecule (e.g., in a mammalian host cell, such as a genomic DNA molecule in the host cell). In some embodiments, the gene modifying polypeptide is capable of integrating the sequence substantially without relying on host machinery. In some embodiments, the gene modifying polypeptide integrates a sequence into a random position in a genome, and in some embodiments, the gene modifying polypeptide integrates a sequence into a specific target site. In some embodiments, a gene modifying polypeptide includes one or more domains that, collectively, facilitate 1) binding the template nucleic acid, 2) binding the target DNA molecule, and 3) facilitate integration of the at least a portion of the template nucleic acid into the target DNA. Gene modifying polypeptides include both naturally occurring polypeptides as well as engineered variants of the foregoing, e.g., having one or more amino acid substitutions to the naturally occurring sequence. Gene modifying polypeptides also include heterologous constructs, e.g., where one or more of the domains recited above are heterologous to each other, whether through a heterologous fusion (or other conjugate) of otherwise wild-type domains, as well as fusions of modified domains, e.g., by way of replacement or fusion of a heterologous sub-domain or other substituted domain. Exemplary gene modifying polypeptides, and systems comprising them and methods of using them, that can be used in the methods provided herein are described, e.g., in PCT/US2021/020948, which is incorporated herein by reference with respect to gene modifying polypeptides that comprise a retroviral reverse transcriptase domain. In some embodiments, a gene modifying polypeptide integrates a sequence into a gene. In some embodiments, a gene modifying polypeptide integrates a sequence into a sequence outside of a gene. A "gene modifying system," as used herein, refers to a system comprising a gene modifying polypeptide and a template nucleic acid.

The term "domain" as used herein refers to a structure of a biomolecule that contributes to a specified function of the biomolecule. A domain may comprise a contiguous region (e.g., a contiguous sequence) or distinct, non-contiguous regions (e.g., non-contiguous sequences) of a biomolecule. Examples of protein domains include, but are not limited to, an endonuclease domain, a DNA binding domain, a reverse transcription domain; an example of a domain of a nucleic acid is a regulatory domain, such as a transcription factor binding domain. In some embodiments, a domain (e.g., a Cas domain) can comprise two or more smaller domains (e.g., a DNA binding domain and an endonuclease domain).

As used herein, the term "exogenous," when used with reference to a biomolecule (such as a nucleic acid sequence or polypeptide) means that the biomolecule was introduced into a host genome, cell or organism by the hand of man. For example, a nucleic acid that is as added into an existing genome, cell, tissue or subject using recombinant DNA techniques or other methods is exogenous to the existing nucleic acid sequence, cell, tissue or subject.

As used herein, "first strand" and "second strand," as used to describe the individual DNA strands of target DNA, distinguish the two DNA strands based upon which strand the reverse transcriptase domain initiates polymerization, e.g., based upon where target primed synthesis initiates. The first strand refers to the strand of the target DNA upon which the reverse transcriptase domain initiates polymerization, e.g., where target primed synthesis initiates. The second strand refers to the other strand of the target DNA. First and second strand designations do not describe the target site DNA strands in other respects; for example, in some embodiments the first and second strands are nicked by a polypeptide described herein, but the designations 'first' and 'second' strand have no bearing on the order in which such nicks occur.

A "genomic safe harbor site" (GSH site) is a site in a host genome that is able to accommodate the integration of new genetic material, e.g., such that the inserted genetic element does not cause significant alterations of the host genome posing a risk to the host cell or organism. A GSH site generally meets 1, 2, 3, 4, 5, 6, 7, 8 or 9 of the following criteria: (i) is located >300kb from a cancer-related gene; (ii) is >300kb from a miRNA/other functional small RNA; (iii) is >50kb from a 5' gene end; (iv) is >50kb from a replication origin; (v) is >50kb away from any ultraconservered element; (vi) has low transcriptional activity (i.e. no mRNA +/−25 kb); (vii) is not in a copy number variable region; (viii) is in open chromatin; and/or (ix) is unique, with 1 copy in the human genome. Examples of GSH sites in the human genome that meet some or all of these criteria include (i) the adeno-associated virus site 1 (AAVS 1), a naturally occurring site of integration of AAV virus on chromosome 19; (ii) the chemokine (C-C motif) receptor 5 (CCR5) gene, a chemokine receptor gene known as an HIV-1 coreceptor; (iii) the human ortholog of the mouse Rosa26 locus; (iv) the ribosomal DNA ("rDNA") locus. Additional GSH sites are known and described, e.g., in Pellenz et al. epub Aug. 20, 2018 (doi.org/10.1101/396390).

The term "heterologous," as used herein to describe a first element in reference to a second element means that the first element and second element do not exist in nature disposed as described. For example, a heterologous polypeptide, nucleic acid molecule, construct or sequence refers to (a) a polypeptide, nucleic acid molecule or portion of a polypeptide or nucleic acid molecule sequence that is not native to a cell in which it is expressed, (b) a polypeptide or nucleic acid molecule or portion of a polypeptide or nucleic acid molecule that has been altered or mutated relative to its native state, or (c) a polypeptide or nucleic acid molecule with an altered expression as compared to the native expression levels under similar conditions. For example, a heterologous regulatory sequence (e.g., promoter, enhancer) may be used to regulate expression of a gene or a nucleic acid molecule in a way that is different than the gene or a nucleic acid molecule is normally expressed in nature. In another example, a heterologous domain of a polypeptide or nucleic acid sequence (e.g., a DNA binding domain of a polypeptide or nucleic acid encoding a DNA binding domain of a polypeptide) may be disposed relative to other domains or may be a different sequence or from a different source, relative to other domains or portions of a polypeptide or its encoding nucleic acid. In certain embodiments, a heterologous nucleic acid molecule may exist in a native host cell genome, but may have an altered expression level or have a different sequence or both. In other embodiments, heterologous nucleic acid molecules may not be endogenous to a host cell or host genome but instead may have been introduced into a host cell by transformation (e.g., transfection, electroporation), wherein the added molecule may integrate into the host genome or can exist as extra-chromosomal genetic material either transiently (e.g., mRNA) or semi-stably for more than one generation (e.g., episomal viral vector, plasmid or other self-replicating vector).

As used herein, "insertion" of a sequence into a target site refers to the net addition of DNA sequence at the target site, e.g., where there are new nucleotides in the heterologous object sequence with no cognate positions in the unedited target site. In some embodiments, a nucleotide alignment of the PBS sequence and heterologous object sequence to the target nucleic acid sequence would result in an alignment gap in the target nucleic acid sequence.

As used herein, a "deletion" generated by a heterologous object sequence in a target site refers to the net deletion of DNA sequence at the target site, e.g., where there are nucleotides in the unedited target site with no cognate positions in the heterologous object sequence. In some embodiments, a nucleotide alignment of the PBS sequence and heterologous object sequence to the target nucleic acid sequence would result in an alignment gap in the molecule comprising the PBS sequence and heterologous object sequence.

The term "inverted terminal repeats" or "ITRs" as used herein refers to AAV viral cis-elements named so because of their symmetry. These elements promote efficient multiplication of an AAV genome. It is hypothesized that the minimal elements for ITR function are a Rep-binding site (RBS; 5'-GCGCGCTCGCTCGCTC-3' for AAV2; SEQ ID NO: 4601) and a terminal resolution site (TRS; 5'-AGTTGG-3' for AAV2) plus a variable palindromic sequence allowing for hairpin formation. According to the present invention, an ITR comprises at least these three elements (RBS, TRS, and sequences allowing the formation of a hairpin). In addition, in the present invention, the term "ITR" refers to ITRs of known natural AAV serotypes (e.g. ITR of a serotype 1, 2, 3, 4, 5, 6, 7, 8, 9, 10 or 11 AAV), to chimeric ITRs formed by the fusion of ITR elements derived from different serotypes, and to functional variants thereof. "Functional variant" refers to a sequence presenting a sequence identity of at least 80%, 85%, 90%, preferably of at least 95% with a known ITR and allowing multiplication of the sequence that includes said ITR in the presence of Rep proteins.

The term "mutation region," as used herein, refers to a region in a template RNA having one or more sequence difference relative to the corresponding sequence in a target nucleic acid. The sequence difference may comprise, for example, a substitution, insertion, frameshift, or deletion.

The term "mutated" when applied to nucleic acid sequences means that nucleotides in a nucleic acid sequence are inserted, deleted, or changed compared to a reference (e.g., native) nucleic acid sequence. A single alteration may be made at a locus (a point mutation), or multiple nucleotides may be inserted, deleted, or changed at a single locus. In addition, one or more alterations may be made at any number of loci within a nucleic acid sequence. A nucleic acid sequence may be mutated by any method known in the art.

"Nucleic acid molecule" refers to both RNA and DNA molecules including, without limitation, complementary DNA ("cDNA"), genomic DNA ("gDNA"), and messenger RNA ("mRNA"), and also includes synthetic nucleic acid molecules, such as those that are chemically synthesized or recombinantly produced, such as RNA templates, as described herein. The nucleic acid molecule can be double-stranded or single-stranded, circular, or linear. If single-stranded, the nucleic acid molecule can be the sense strand or the antisense strand. Unless otherwise indicated, and as an example for all sequences described herein under the general format "SEQ ID NO:," "nucleic acid comprising SEQ ID NO:1" refers to a nucleic acid, at least a portion which has either (i) the sequence of SEQ ID NO:1, or (ii) a sequence complimentary to SEQ ID NO: 1. The choice between the two is dictated by the context in which SEQ ID NO:1 is used. For instance, if the nucleic acid is used as a probe, the choice between the two is dictated by the requirement that the probe be complementary to the desired target. Nucleic acid sequences of the present disclosure may be modified chemically or biochemically or may contain non-natural or derivatized nucleotide bases, as will be readily appreciated by those of skill in the art. Such modifications include, for example, labels, methylation, substitution of one or more naturally occurring nucleotides with an analog, inter-nucleotide modifications such as uncharged linkages (for example, methyl phosphonates, phosphotriesters, phosphoramidates, carbamates, etc.), charged linkages (for example, phosphorothioates, phosphorodithioates, etc.), pendant moieties, (for example, polypeptides), intercalators (for example, acridine, psoralen, etc.), chelators, alkylators, and modified linkages (for example, alpha anomeric nucleic acids, etc.). Also included are chemically modified bases (see, for example, Table 13, infra), backbones (see, for example, Table 14, infra), and modified caps (see, for example, Table 15, infra). Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of a molecule, e.g., peptide nucleic acids (PNAs). Other modifications can include, for example, analogs in which the ribose ring contains a bridging moiety or other structure such as modifications found in "locked" nucleic acids (LNAs). In various embodiments, the nucleic acids are in operative association with additional genetic elements, such as tissue-specific expression-control sequence(s) (e.g., tissue-specific promoters and tissue-specific microRNA recognition sequences), as well as additional elements, such as inverted repeats (e.g., inverted terminal repeats, such as elements from or derived from viruses, e.g., AAV ITRs) and tandem repeats, inverted repeats/direct repeats, homology regions (segments with various degrees of homology to a target DNA), untranslated regions (UTRs) (5', 3', or both 5' and 3' UTRs), and various combinations of the foregoing. The nucleic acid elements of the systems provided by the invention can be provided in a variety of topologies, including single-stranded, double-stranded, circular, linear, linear with open ends, linear with closed ends, and particular versions of these, such as doggybone DNA (dbDNA), closed-ended DNA (ceDNA).

As used herein, a "gene expression unit" is a nucleic acid sequence comprising at least one regulatory nucleic acid sequence operably linked to at least one effector sequence. A first nucleic acid sequence is operably linked with a second nucleic acid sequence when the first nucleic acid sequence is placed in a functional relationship with the second nucleic acid sequence. For instance, a promoter or enhancer is operably linked to a coding sequence if the promoter or enhancer affects the transcription or expression of the coding sequence. Operably linked DNA sequences may be contiguous or non-contiguous. Where necessary to join two protein-coding regions, operably linked sequences may be in the same reading frame.

The terms "host genome" or "host cell," as used herein, refer to a cell and/or its genome into which protein and/or genetic material has been introduced. It should be understood that such terms are intended to refer not only to the particular subject cell and/or genome, but to the progeny of such a cell and/or the genome of the progeny of such a cell. Because certain modifications may occur in succeeding generations due to either mutation or environmental influences, such progeny may not, in fact, be identical to the parent cell, but are still included within the scope of the term "host cell" as used herein. A host genome or host cell may be an isolated cell or cell line grown in culture, or genomic material isolated from such a cell or cell line, or may be a host cell or host genome which composing living tissue or an organism. In some instances, a host cell may be an animal cell or a plant cell, e.g., as described herein. In certain instances, a host cell may be a mammalian cell, a human cell, avian cell, reptilian cell, bovine cell, horse cell, pig cell, goat cell, sheep cell, chicken cell, or turkey cell. In certain instances, a host cell may be a corn cell, soy cell, wheat cell, or rice cell.

As used herein, "operative association" describes a functional relationship between two nucleic acid sequences, such as a 1) promoter and 2) a heterologous object sequence, and means, in such example, the promoter and heterologous object sequence (e.g., a gene of interest) are oriented such that, under suitable conditions, the promoter drives expression of the heterologous object sequence. For instance, a template nucleic acid carrying a promoter and a heterologous object sequence may be single-stranded, e.g., either the (+) or (−) orientation. An "operative association" between the promoter and the heterologous object sequence in this template means that, regardless of whether the template nucleic acid will be transcribed in a particular state, when it is in the suitable state (e.g., is in the (+) orientation, in the presence of required catalytic factors, and NTPs, etc.), it is accurately transcribed. Operative association applies analogously to other pairs of nucleic acids, including other tissue-specific expression control sequences (such as enhancers, repressors and microRNA recognition sequences), IR/DR, ITRs, UTRs, or homology regions and heterologous object sequences or sequences encoding a retroviral RT domain.

As used herein, a "stem-loop sequence" refers to a nucleic acid sequence (e.g., RNA sequence) with sufficient self-complementarity to form a stem-loop, e.g., having a stem comprising at least two (e.g., 3, 4, 5, 6, 7, 8, 9, or 10) base pairs, and a loop with at least three (e.g., four) base pairs. The stem may comprise mismatches or bulges.

As used herein, a "tissue-specific expression-control sequence" means nucleic acid elements that increase or decrease the level of a transcript comprising the heterologous object sequence in a target tissue in a tissue-specific manner, e.g., preferentially in on-target tissue(s), relative to off-target tissue(s). In some embodiments, a tissue-specific expression-control sequence preferentially drives or represses transcription, activity, or the half-life of a transcript comprising the heterologous object sequence in the target tissue in a tissue-specific manner, e.g., preferentially in an on-target tissue(s), relative to an off-target tissue(s). Exemplary tissue-specific expression-control sequences include tissue-specific promoters, repressors, enhancers, or combinations thereof, as well as tissue-specific microRNA recognition sequences. Tissue specificity refers to on-target (tissue(s) where expression or activity of the template nucleic acid is desired or tolerable) and off-target (tissue(s) where expression or activity of the template nucleic acid is not desired or is not tolerable). For example, a tissue-specific promoter drives expression preferentially in on-target tissues, relative to off-target tissues. In contrast, a microRNA that binds the tissue-specific microRNA recognition sequences is preferentially expressed in off-target tissues, relative to on-target tissues, thereby reducing expression of a template nucleic acid in off-target tissues. Accordingly, a promoter and a microRNA recognition sequence that are specific for the same tissue, such as the target tissue, have contrasting functions (promote and repress, respectively, with concordant expression levels, i.e., high levels of the microRNA in off-target tissues and low levels in on-target tissues, while promoters drive high expression in on-target tissues and low expression in off-target tissues) with regard to the transcription, activity, or half-life of an associated sequence in that tissue.

TABLE OF CONTENTS

1) Introduction
2) Gene modifying systems
   a) Polypeptide components of gene modifying systems
      i) Writing domain
      ii) Endonuclease domains and DNA binding domains
         (1) Gene modifying polypeptides comprising Cas domains
         (2) TAL Effectors and Zinc Finger Nucleases
      iii) Linkers
      iv) Localization sequences for gene modifying systems
      v) Evolved Variants of Gene Modifying Polypeptides and Systems
      vi) Inteins
      vii) Additional domains
   b) Template nucleic acids
      i) gRNA spacer and gRNA scaffold
      ii) Heterologous object sequence
      iii) PBS sequence
      iv) Exemplary Template Sequences
   c) gRNAs with inducible activity
   d) Circular RNAs and Ribozymes in Gene Modifying Systems
   e) Target Nucleic Acid Site
   f) Second strand nicking
3) Production of Compositions and Systems
4) Therapeutic Applications 5) Administration and Delivery
   a) Tissue Specific Activity/Administration
      i) Promoters
      ii) microRNAs
   b) Viral vectors and components thereof
   c) AAV Administration
   d) Lipid Nanoparticles
6) Kits, Articles of Manufacture, and Pharmaceutical Compositions
7) Chemistry, Manufacturing, and Controls (CMC)

INTRODUCTION

This disclosure relates to methods compositions for targeting, editing, modifying or manipulating a DNA sequence (e.g., inserting a heterologous object sequence into a target site of a mammalian genome) at one or more locations in a DNA sequence in a cell, tissue or subject, e.g., in vivo or in vitro. The heterologous object DNA sequence may include, e.g., a substitution, a deletion, an insertion, e.g., a coding sequence, a regulatory sequence, or a gene expression unit.

The disclosure also provides methods for treating disease using reverse transcriptase-based systems for altering a genomic DNA sequence of interest, e.g., by inserting, deleting, or substituting one or more nucleotides into/from the sequence of interest.

The disclosure provides, in part, methods for treating disease using a gene modifying system comprising a gene modifying polypeptide component and a template nucleic acid (e.g., template RNA) component. In some embodiments, a gene modifying system can be used to introduce an alteration into a target site in a genome. In some embodiments, the gene modifying polypeptide component comprises a writing domain (e.g., a reverse transcriptase domain), a DNA-binding domain, and an endonuclease domain (e.g., nickase domain). In some embodiments, the template nucleic acid (e.g., template RNA) comprises a sequence (e.g., a gRNA spacer) that binds a target site in the genome (e.g., that binds to a second strand of the target site), a sequence (e.g., a gRNA scaffold) that binds the gene modifying polypeptide component, a heterologous object sequence, and a PBS sequence. Without wishing to be bound by theory, it is thought that the template nucleic acid (e.g., template RNA) binds to the second strand of a target site in the genome, and binds to the gene modifying polypeptide component (e.g., localizing the polypeptide component to the target site in the genome). It is thought that the endonuclease (e.g., nickase) of the gene modifying polypeptide component cuts the target site (e.g., the first strand of the target site), e.g., allowing the PBS sequence to bind to a sequence adjacent to the site to be altered on the first strand of the target site. It is thought that the writing domain (e.g., reverse transcriptase domain) of the polypeptide component uses the first strand of the target site that is bound to the complementary sequence comprising the PBS sequence of the template nucleic acid as a primer and the heterologous object sequence of the template nucleic acid as a template to, e.g., polymerize a sequence complementary to the heterologous object sequence. Without wishing to be bound by theory, it is thought that selection of an appropriate heterologous object sequence can result in substitution, deletion, and/or insertion of one or more nucleotides at the target site.

Gene Modifying Systems

In some embodiments, a gene modifying system described herein comprises: (A) a gene modifying polypeptide or a nucleic acid encoding the gene modifying polypeptide, wherein the gene modifying polypeptide comprises (i) a reverse transcriptase domain, and either (x) an endonuclease domain that contains DNA binding functionality or (y) an endonuclease domain and separate DNA binding domain; and (B) a template RNA. A gene modifying polypeptide, in some embodiments, acts as a substantially autonomous protein machine capable of integrating a template nucleic acid sequence into a target DNA molecule (e.g., in a mammalian host cell, such as a genomic DNA molecule in the host cell), substantially without relying on host machinery. For example, the gene modifying protein may comprise a DNA-binding domain, a reverse transcriptase domain, and an endonuclease domain. In some embodiments, the DNA-binding function may involve an RNA component that directs the protein to a DNA sequence, e.g., a gRNA spacer. In other embodiments, the gene modifying polypeptide may comprise a reverse transcriptase domain and an endonuclease domain. The RNA template element of a gene modifying system is typically heterologous to the gene modifying polypeptide element and provides an object sequence to be inserted (reverse transcribed) into the host genome. In some embodiments, the gene modifying polypeptide is capable of target primed reverse transcription. In some embodiments, the gene modifying polypeptide is capable of second-strand synthesis.

In some embodiments the gene modifying system is combined with a second polypeptide. In some embodiments, the second polypeptide may comprise an endonuclease domain. In some embodiments, the second polypeptide may comprise a polymerase domain, e.g., a reverse transcriptase domain. In some embodiments, the second polypeptide may comprise a DNA-dependent DNA polymerase domain. In some embodiments, the second polypeptide aids in completion of the genome edit, e.g., by contributing to second-strand synthesis or DNA repair resolution.

A functional gene modifying polypeptide can be made up of unrelated DNA binding, reverse transcription, and endonuclease domains. This modular structure allows combining of functional domains, e.g., dCas9 (DNA binding), MMLV reverse transcriptase (reverse transcription), FokI (endonuclease). In some embodiments, multiple functional domains may arise from a single protein, e.g., Cas9 or Cas9 nickase (DNA binding, endonuclease).

In some embodiments, a gene modifying polypeptide includes one or more domains that, collectively, facilitate 1) binding the template nucleic acid, 2) binding the target DNA molecule, and 3) facilitate integration of the at least a portion of the template nucleic acid into the target DNA. In some embodiments, the gene modifying polypeptide is an engineered polypeptide that comprises one or more amino acid substitutions to a corresponding naturally occurring sequence. In some embodiments, the gene modifying polypeptide comprises two or more domains that are heterologous relative to each other, e.g., through a heterologous fusion (or other conjugate) of otherwise wild-type domains, or well as fusions of modified domains, e.g., by way of replacement or fusion of a heterologous sub-domain or other substituted domain. For instance, in some embodiments, one or more of: the RT domain is heterologous to the DBD; the DBD is heterologous to the endonuclease domain; or the RT domain is heterologous to the endonuclease domain.

In some embodiments, a template RNA molecule for use in the system comprises, from 5' to 3' (1) a gRNA spacer; (2) a gRNA scaffold; (3) heterologous object sequence (4) a primer binding site (PBS) sequence. In some embodiments:
   (1) Is a gRNA spacer of ~18-22 nt, e.g., is 20 nt
   (2) Is a gRNA scaffold comprising one or more hairpin loops, e.g., 1, 2, of 3 loops for associating the template with a Cas domain, e.g., a nickase Cas9 domain. In some embodiments, the gRNA scaffold comprises the sequence, from 5' to 3', (SEQ ID NO: 5008)
GTTTTAGAGCTAGAAATAGCAAGTTAAAATAAGGCTAGTCCGTTATCAA
CTTGAAAAAGTGGGACCGAGTCGGTCC.

(3) In some embodiments, the heterologous object sequence is, e.g., 7-74, e.g., 10-20, 20-30, 30-40, 40-50, 50-60, 60-70, or 70-80 nt or, 80-90 nt in length. In some embodiments, the first (most 5') base of the sequence is not C.

(4) In some embodiments, the PBS sequence that binds the target priming sequence after nicking occurs is e.g., 3-20 nt, e.g., 7-15 nt, e.g., 12-14 nt. In some embodiments, the PBS sequence has 40-60% GC content.

In some embodiments, a second gRNA associated with the system may help drive complete integration. In some embodiments, the second gRNA may target a location that is 0-200 nt away from the first-strand nick, e.g., 0-50, 50-100, 100-200 nt away from the first-strand nick. In some embodiments, the second gRNA can only bind its target sequence after the edit is made, e.g., the gRNA binds a sequence present in the heterologous object sequence, but not in the initial target sequence.

In some embodiments, a gene modifying system described herein is used to make an edit in HEK293, K562, U2OS, or HeLa cells. In some embodiment, a gene modifying system is used to make an edit in primary cells, e.g., primary cortical neurons from E18.5 mice.

In some embodiments, a gene modifying polypeptide as described herein comprises a reverse transcriptase or RT domain (e.g., as described herein) that comprises a MoMLV RT sequence or variant thereof. In embodiments, the MoMLV RT sequence comprises one or more mutations selected from D200N, L603W, T330P, T306K, W313F, D524G, E562Q, D583N, P51L, S67R, E67K, T197A, H204R, E302K, F309N, L435G, N454K, H594Q, D653N, R110S, and K103L. In embodiments, the MoMLV RT sequence comprises a combination of mutations, such as D200N, L603W, and T330P, optionally further including T306K and/or W313F.

In some embodiments, an endonuclease domain (e.g., as described herein) comprises nCAS9, e.g., comprising the H840A mutation.

In some embodiments, the heterologous object sequence (e.g., of a system as described herein) is about 1-50, 50-100, 100-200, 200-300, 300-400, 400-500, 500-600, 600-700, 700-800, 800-900, 900-1000, or more, nucleotides in length.

In some embodiments, the RT and endonuclease domains are joined by a flexible linker, e.g., comprising the amino acid sequence SGGSSGGSSGSETPGTSESAT-PESSGGSSGGSS (SEQ ID NO: 5006).

In some embodiments, the endonuclease domain is N-terminal relative to the RT domain. In some embodiments, the endonuclease domain is C-terminal relative to the RT domain.

In some embodiments, the system incorporates a heterologous object sequence into a target site by TPRT, e.g., as described herein.

In some embodiments, a gene modifying polypeptide comprises a DNA binding domain. In some embodiments, a gene modifying polypeptide comprises an RNA binding domain. In some embodiments, the RNA binding domain comprises an RNA binding domain of B-box protein, MS2 coat protein, dCas, or an element of a sequence of a table herein. In some embodiments, the RNA binding domain is capable of binding to a template RNA with greater affinity than a reference RNA binding domain.

In some embodiments, a gene modifying system is capable of producing an insertion into the target site of at least 45, 50, 55, 60, 65, 70, 75, 80, 85, 90, 95, or 100 nucleotides (and optionally no more than 500, 400, 300, 200, or 100 nucleotides). In some embodiments, a gene modifying system is capable of producing an insertion into the target site of at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides (and optionally no more than 500, 400, 300, 200, or 100 nucleotides). In some embodiments, a gene modifying system is capable of producing an insertion into the target site of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a gene modifying system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200 nucleotides (and optionally no more than 500, 400, 300, or 200 nucleotides). In some embodiments, a gene modifying system is capable of producing a deletion of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a gene modifying system is capable of producing a substitution into the target site of at least 1, 2, 3, 4, 5, 6, 7, 8, 9, 10, 15, 20, 25, 30, 35, 40, 45, 50, 60, 70, 80, 90, or 100 or more nucleotides. In some embodiments, a gene modifying system is capable of producing a substitution in the target site of 1-2, 2-3, 3-4, 4-5, 5-10, 10-15, 15-20, 20-30, 30-40, 40-50, 50-60, 60-70, 70-80, 80-90, or 90-100 nucleotides.

In some embodiments, the substitution is a transition mutation. In some embodiments, the substitution is a transversion mutation. In some embodiments, the substitution converts an adenine to a thymine, an adenine to a guanine, an adenine to a cytosine, a guanine to a thymine, a guanine to a cytosine, a guanine to an adenine, a thymine to a cytosine, a thymine to an adenine, a thymine to a guanine, a cytosine to an adenine, a cytosine to a guanine, or a cytosine to a thymine.

In some embodiments, an insertion, deletion, substitution, or combination thereof, increases or decreases expression (e.g. transcription or translation) of a gene. In some embodiments, an insertion, deletion, substitution, or combination thereof, increases or decreases expression (e.g. transcription or translation) of a gene by altering, adding, or deleting sequences in a promoter or enhancer, e.g. sequences that bind transcription factors. In some embodiments, an insertion, deletion, substitution, or combination thereof alters translation of a gene (e.g. alters an amino acid sequence), inserts or deletes a start or stop codon, alters or fixes the translation frame of a gene. In some embodiments, an insertion, deletion, substitution, or combination thereof alters splicing of a gene, e.g. by inserting, deleting, or altering a splice acceptor or donor site. In some embodiments, an insertion, deletion, substitution, or combination thereof alters transcript or protein half-life. In some embodiments, an insertion, deletion, substitution, or combination thereof alters protein localization in the cell (e.g. from the cytoplasm to a mitochondria, from the cytoplasm into the extracellular space (e.g. adds a secretion tag)). In some embodiments, an insertion, deletion, substitution, or combination thereof alters (e.g. improves) protein folding (e.g. to prevent accumulation of misfolded proteins). In some embodiments, an insertion, deletion, substitution, or combination thereof, alters, increases, decreases the activity of a gene, e.g. a protein encoded by the gene.

Exemplary gene modifying polypeptides, and systems comprising them and methods of using them are described, e.g., in PCT/US2021/020948, which is incorporated herein by reference with respect to retroviral RT domains, including the amino acid and nucleic acid sequences therein.

Exemplary gene modifying polypeptides and retroviral RT domain sequences are also described, e.g., in International Application No. PCT/US21/20948 filed Mar. 4, 2021, e.g., at Table 30, Table 31, and Table 44 therein; the entire application is incorporated by reference herein with respect to retroviral RTs, e.g., in said sequences and tables. Accordingly, a gene modifying polypeptide described herein may comprise an amino acid sequence according to any of the Tables mentioned in this paragraph, or a domain thereof (e.g., a retroviral RT domain), or a functional fragment or variant of any of the foregoing, or an amino acid sequence having at least 70%, 80%, 85%, 90%, 95%, or 99% identity thereto.

In some embodiments, a polypeptide for use in any of the systems described herein can be a molecular reconstruction or ancestral reconstruction based upon the aligned polypeptide sequence of multiple homologous proteins. In some embodiments, a reverse transcriptase domain for use in any of the systems described herein can be a molecular reconstruction or an ancestral reconstruction, or can be modified at particular residues, based upon alignments of reverse transcriptase domains from the same or different sources. A skilled artisan can, based on the Accession numbers provided herein, align polypeptides or nucleic acid sequences, e.g., by using routine sequence analysis tools as Basic Local Alignment Search Tool (BLAST) or CD-Search for conserved domain analysis. Molecular reconstructions can be created based upon sequence consensus, e.g. using approaches described in Ivics et al., Cell 1997, 501-510; Wagstaff et al., Molecular Biology and Evolution 2013, 88-99.

Polypeptide Components Of Gene Modifying Systems

In some embodiments, the gene modifying polypeptide possesses the functions of DNA target site binding, template nucleic acid (e.g., RNA) binding, DNA target site cleavage, and template nucleic acid (e.g., RNA) writing, e.g., reverse transcription. In some embodiments, each function is contained within a distinct domain. In some embodiments, a function may be attributed to two or more domains (e.g., two or more domains, together, exhibit the functionality). In some embodiments, two or more domains may have the same or similar function (e.g., two or more domains each independently have DNA-binding functionality, e.g., for two different DNA sequences). In other embodiments, one or more domains may be capable of enabling one or more functions, e.g., a Cas9 domain enabling both DNA binding and target site cleavage. In some embodiments, the domains are all located within a single polypeptide. In some embodiments, a first domain is in one polypeptide and a second domain is in a second polypeptide. For example, in some embodiments, the sequences may be split between a first polypeptide and a second polypeptide, e.g., wherein the first polypeptide comprises a reverse transcriptase (RT) domain and wherein the second polypeptide comprises a DNA-binding domain and an endonuclease domain, e.g., a nickase domain. As a further example, in some embodiments, the first polypeptide and the second polypeptide each comprise a DNA binding domain (e.g., a first DNA binding domain and a second DNA binding domain). In some embodiments, the first and second polypeptide may be brought together post-translationally via a split-intein to form a single gene modifying polypeptide.

In an aspect, the disclosure provides a gene modifying polypeptide comprising:
a DNA binding domain (DBD) that binds to a target nucleic acid sequence,
the RT domain of an AVIRE RT, or an amino acid sequence having at least 70%, 75%, 80%, 85%, 90%, 95%, 96%, 97%, 98%, or 99% identity thereto, and
a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
a DNA binding domain (DBD) that binds to a target nucleic acid sequence,
the RT domain of an BAEVM RT, or an amino acid sequence having at least 70%, 75%, 80%, 85%, 90%, 95%, 96%, 97%, 98%, or 99% identity thereto, and
a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
a DNA binding domain (DBD) that binds to a target nucleic acid sequence,
the RT domain of an FFV RT, or an amino acid sequence having at least 70%, 75%, 80%, 85%, 90%, 95%, 96%, 97%, 98%, or 99% identity thereto, and
a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
a DNA binding domain (DBD) that binds to a target nucleic acid sequence,
the RT domain of an FLV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an FOAMV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an GALV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an KORV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MLVAV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MLVBM RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MLVCB RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MLVFF RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MLVMS RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an PERV RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an SFV1 RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an SFV3L RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an WMSV RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an XMRV6 RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an BLVAU RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an BLVJ RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTL1A RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTL1C RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTL1L RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTL32 RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTL3P RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an HTLV2 RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an JSRV RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an MLVF5 RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence,
- the RT domain of an MLVRD RT, or an amino acid sequence having at least 70%, 75%, 80%, 85%, 90%, 95%, 96%, 97%, 98%, or 99% identity thereto, and
- a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);
- wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:
- a DNA binding domain (DBD) that binds to a target nucleic acid sequence, the RT domain of an MMTVB RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an MPMV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an SFVCP RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an SMRVH RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an SRV1 RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an SRV2 RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

In an aspect, the disclosure provides a gene modifying polypeptide comprising:

a DNA binding domain (DBD) that binds to a target nucleic acid sequence, the RT domain of an WDSV RT, or an amino acid sequence having at least 70%, 75%, 80%, 85%, 90%, 95%, 96%, 97%, 98%, or 99% identity thereto, and a linker disposed between the DBD and the RT domain (e.g., a linker comprising an amino acid sequence as listed in Table 10, or an amino acid sequence having at least 70%, 75%, 80%, 85%, 90%, 95%, 96%, 97%, 98%, or 99% identity thereto);

wherein the DBD is heterologous to the RT domain (e.g., a Cas domain, e.g., a Cas nickase domain, e.g., a Cas9 nickase domain); optionally wherein the RT domain is C-terminal of the Cas domain.

Gene Modifying Domain (RT Domain)

In certain aspects of the present invention, the gene modifying domain of the gene modifying system possesses reverse transcriptase activity and is also referred to as a reverse transcriptase domain (an RT domain). In some embodiments, the RT domain comprises an RT catalytic portion and RNA-binding region (e.g., a region that binds the template RNA).

In some embodiments, a nucleic acid encoding the reverse transcriptase is altered from its natural sequence to have altered codon usage, e.g. improved for human cells. In some embodiments the reverse transcriptase domain is a heterologous reverse transcriptase from a retrovirus. In some embodiments, the RT domain comprising a gene modifying polypeptide has been mutated from its original amino acid sequence, e.g., has at least 1, 2, 3, 4, 5, 6, 7, 8, 9, 10, 20, 30, 40, 50, 60, 70, 80, 90, or 100 substitutions. In some embodiments, the RT domain is derived from the RT of a retrovirus, e.g., HIV-1 RT, Moloney Murine Leukemia Virus (MMLV) RT, avian myeloblastosis virus (AMV) RT, or Rous Sarcoma Virus (RSV) RT.

In some embodiments, the retroviral reverse transcriptase (RT) domain exhibits enhanced stringency of target-primed reverse transcription (TPRT) initiation, e.g., relative to an endogenous RT domain. In some embodiments, the RT domain initiates TPRT when the 3 nt in the target site immediately upstream of the first strand nick, e.g., the genomic DNA priming the RNA template, have at least 66% or 100% complementarity to the 3 nt of homology in the RNA template. In some embodiments, the RT domain initiates TPRT when there are less than 5 nt mismatched (e.g., less than 1, 2, 3, 4, or 5 nt mismatched) between the template RNA homology and the target DNA priming reverse transcription. In some embodiments, the RT domain is modified such that the stringency for mismatches in priming the TPRT reaction is increased, e.g., wherein the RT domain does not tolerate any mismatches or tolerates fewer mismatches in the priming region relative to a wild-type (e.g., unmodified) RT domain. In some embodiments, the RT domain comprises a HIV-1 RT domain. In embodiments, the HIV-1 RT domain initiates lower levels of synthesis even with three nucleotide mismatches relative to an alternative RT domain (e.g., as described by Jamburuthugoda and Eickbush J Mol Biol 407(5):661-672 (2011); incorporated herein by reference in its entirety). In some embodiments, the RT domain forms a dimer (e.g., a heterodimer or homodimer). In some embodiments, the RT domain is monomeric. In some embodiments, an RT domain, naturally functions as a monomer or as a dimer (e.g., heterodimer or homodimer). In some embodiments, an RT domain naturally functions as a monomer, e.g., is derived from a virus wherein it functions as a monomer. In embodiments, the RT domain is selected from an RT domain from murine leukemia virus (MLV; sometimes referred to as MoMLV) (e.g., P03355), porcine endogenous retrovirus (PERV) (e.g., UniProt Q4VFZ2), mouse mammary tumor virus (MMTV) (e.g., UniProt P03365), Mason-Pfizer monkey virus (MPMV) (e.g., UniProt P07572), bovine leukemia virus (BLV) (e.g., UniProt P03361), human T-cell leukemia virus-1 (HTLV-1) (e.g., UniProt P03362), human foamy virus (IFV) (e.g., UniProt P14350), simian foamy virus (SFV) (e.g., UniProt P23074), or bovine foamy/syncytial virus (BFV/BSV) (e.g., UniProt O41894), or a functional fragment or variant thereof (e.g., an amino acid sequence having at least 70%, 80%, 90%, 95%, or 99% identity thereto). In some embodiments, an RT domain is dimeric in its natural functioning. In some embodiments, the RT domain is derived from a virus wherein it functions as a dimer. In embodiments, the RT domain is selected from an RT domain from avian sarcoma/leukemia virus (ASLV) (e.g., UniProt A0A142BKH1), Rous sarcoma virus (RSV) (e.g., UniProt P03354), avian myeloblastosis virus (AMV) (e.g., UniProt Q83133), human immunodeficiency virus type I (HIV-1) (e.g., UniProt P03369), human immunodeficiency virus type II (HIV-2) (e.g., UniProt P15833), simian immunodeficiency virus (SIV) (e.g., UniProt P05896), bovine immunodeficiency virus (BIV) (e.g., UniProt P19560), equine infectious anemia virus (EIAV) (e.g., UniProt P03371), or feline immunodeficiency virus (FIV) (e.g., UniProt P16088) (Herschhorn and Hizi Cell Mol Life Sci 67(16):2717-2747 (2010)), or a functional fragment or variant thereof (e.g., an amino acid sequence having at least 70%, 80%, 90%, 95%, or 99% identity thereto). Naturally heterodimeric RT domains may, in some embodiments, also be functional as homodimers. In some embodiments, dimeric RT domains are expressed as fusion proteins, e.g., as homodimeric fusion proteins or heterodimeric fusion proteins. In some embodiments, the RT function of the system is fulfilled by multiple RT domains (e.g., as described herein). In further embodiments, the multiple RT domains are fused or separate, e.g., may be on the same polypeptide or on different polypeptides.

In some embodiments, a gene modifying system described herein comprises an integrase domain, e.g., wherein the integrase domain may be part of the RT domain. In some embodiments, an RT domain (e.g., as described herein) comprises an integrase domain. In some embodiments, an RT domain (e.g., as described herein) lacks an integrase domain, or comprises an integrase domain that has been inactivated by mutation or deleted. In some embodiment, a gene modifying system described herein comprises an RNase H domain, e.g., wherein the RNase H domain may be part of the RT domain. In some embodiments, the RNase H domain is not part of the RT domain and is covalently linked via a flexible linker. In some embodiments, an RT domain (e.g., as described herein) comprises an RNase H domain, e.g., an endogenous RNAse H domain or a heterologous RNase H domain. In some embodiments, an RT domain (e.g., as described herein) lacks an RNase H domain. In some embodiments, an RT domain (e.g., as described herein) comprises an RNase H domain that has been added, deleted, mutated, or swapped for a heterologous RNase H domain. In some embodiments, the polypeptide comprises an inactivated endogenous RNase H domain. In some embodiments, an endogenous RNase H domain from one of the other domains of the polypeptide is genetically removed such that it is not included in the polypeptide, e.g., the endogenous RNase H domain is partially or completely truncated from the comprising domain. In some embodiments, mutation of an RNase H domain yields a polypeptide exhibiting lower RNase activity, e.g., as determined by the methods described in Kotewicz et al. Nucleic Acids Res 16(1):265-277 (1988) (incorporated herein by reference in its entirety), e.g., lower by at least 10%, 20%, 30%, 40%, 50%, 60%, 70%, 80%, or 90% compared to an otherwise similar domain without the mutation. In some embodiments, RNase H activity is abolished.

In some embodiments, an RT domain is mutated to increase fidelity compared to an otherwise similar domain without the mutation. For instance, in some embodiments, a YADD (SEQ ID NO: 15461) or YMDD motif (SEQ ID NO: 15462) in an RT domain (e.g., in a reverse transcriptase) is replaced with YVDD (SEQ ID NO: 15463). In embodiments, replacement of the YADD (SEQ ID NO: 15461) or YMDD (SEQ ID NO: 15462) or YVDD (SEQ ID NO: 15463) results in higher fidelity in retroviral reverse transcriptase activity (e.g., as described in Jamburuthugoda and Eickbush J Mol Biol 2011; incorporated herein by reference in its entirety).

In some embodiments, a gene modifying polypeptide described herein comprises an RT domain having an amino acid sequence according to Table 6, or a sequence having at least 70%, 80%, 85%, 90%, 95%, 97%, 98%, or 99% identity thereto. In some embodiments, a nucleic acid described herein encodes an RT domain having an amino acid sequence according to Table 6, or a sequence having at least 70%, 80%, 85%, 90%, 95%, 97%, 98%, or 99% identity thereto.

TABLE 6

Exemplary reverse transcriptase domains from retroviruses

| RT Name | SEQ ID NO: | RT amino acid sequence |
|---|---|---|
| AVIRE_P03360 | 8,001 | TAPLEEEYRLFLEAPIQNVTLLEQWKREIPKVWAEINPPGLASTQAPIHVQLLSTALPVRVRQYPITLEAKRSLRETIRKFRAAGILRPVSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFD EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGTIGYCRLWIPGFAELAQPLYAATRGGNDPLVWGEKEEEAFQSLKLALTQPPALALPSLDKPPQLFVEETSGAAKGVLTQALGPWKRPVAYLSK RLDPVAAGWPRCLRAIAAAALLTREASKLTFGQDIEITSSHNLESLLRSPPDKWLTNARITQYQVLLLDPPRVRFKQTAALNPATLLPETDDTLPIHHCLD TLDSLTSTRPDLITDQPLAQAEATLFTDGSSYIRDGKRYAGAAVVTLDSVIWAEPLPIGTSAQKAELIALTKALEWSKDKSVNIYTDSRYAFATLHVHGMIY RERRGLLTAGGKAIKNAPEILALLTAVWLPKRVAVMHCKGHQKDDAPTSTGNRRADEVAREVAIRPLSTQATIS |
| AVIRE_P03360_3mut | 8,002 | TAPLEEEYRLFLEAPIQNVTLLEQWKREIPKVWAEINPPGLASTQAPIHVQLLSTALPVRVRQYPITLEAKRSLRETIRKFRAAGILRPVSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGTIGYCRLWIPGFAELAQPLYAATRPGNDPLVWGEKEEEAFQSLKLALTQPPALALPSLDKPPQLFVEETSGAAKGVLTQALGPWKRPVAYLSK RLDPVAAGWPRCLRAIAAAALLTREASKLTFGQDIEITSSHNLESLLRSPPDKWLTNARITQYQVLLLDPPRVRFKQTAALNPATLLPETDDTLPIHHCLD TLDSLTSTRPDLITDQPLAQAEATLFTDGSSYIRDGKRYAGAAVVTLDSVIWAEPLPIGTSAQKAELIALTKALEWSKDKSVNIYTDSRYAFATLHVHGMIY RERRGLLTAGGKAIKNAPEILALLTAVWLPKRVAVMHCKGHQKDDAPTSTGNRRADEVAREVAIRPLSTQATIS |
| AVIRE_P03360_3mutA | 8,003 | TAPLEEEYRLFLEAPIQNVTLLEQWKREIPKVWAEINPPGLASTQAPIHVQLLSTALPVRVRQYPITLEAKRSLRETIRKFRAAGILRPVSPWNTPLLPV RKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQV REFLGKIGYCRLFIPGFAELAQPLYAATRPGNDPLVWGEKEEEAFQSLKLALTQPPALALPSLDKPPQLFVEETSGAAKGVLTQALGPWKRPVAYLSKR LDPVAAGWPRCLRAIAAAALLTREASKLTFGQDIEITSSHNLESLLRSPPDKWLTNARITQYQVLLLDPPRVRFKQTAALNPATLLPETDDTLPIHHCLDT LDSLTSTRPDLITDQPLAQAEATLFTDGSSYIRDGKRYAGAAVVTLDSVIWAEPLPIGTSAQKAELIALTKALEWSKDKSVNIYTDSRYAFATLHVHGMIY RERRGWLTAGGKAIKNAPEILALLTAVWLPKRVAVMHCKGHQKDDAPTSTGNRRADEVAREVAIRPLSTQATIS |
| BAEVM_P10272 | 8,004 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK KPGTQDYRPVQDLREINKRTVDIHPTVPNYNLLSTLKPDYSWYTVLDLKDAFFCLPLAPQSQELFAFEWKDPERGISGQLTWTRLPQGFKNSPTLFD EALHRDLTDFRTQHPEVTLLQYVDDLLLAAPTKKESTPFTWQTEHQLAFEALKKALLSAPALGLPDTSKPFTLFLDERQGIAKGVLTQKLGPWKRPVAYLSKK LDPVAAGWPPCLRIMAATAMLVKDSAKLTLGQPLTVITPHTLEAIVQPPDRWITNARLITHYQALLLDTDRVQFGPPVTLNPATLLPVPENQPSHDCR QVLAETHGTREDLKDQELPDADHTWYTDGSSYLDSGTRRAGAAVVDGHNTIWAQSLPPGTSAQKAELIALTKALELSKGKKANIYTDSRYAFATAHTH GSIYERRGLLTSEGKEIKNKAEIIALLKALFLPQEVAIIHCPGHQKGQDPVAVGNRQADRVARQAAMAEVLTLATEPDNTSHIT |
| BAEVM_P10272_3mut | 8,005 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK KPGTQDYRPVQDLREINKRTVDIHPTVPNYNLLSTLKPDYSWYTVLDLKDAFFCLPLAPQSQELFAFEWKDPERGISGQLTWTRLPQGFKNSPTLFN EALHRDLTDFRTQHPEVTLLQYVDDLLLAAPTKKESTPFTWQTEHQLAFEALKKALLSAPALGLPDTSKPFTLFLDERQGIAKGVLTQKLGPWKRPVAYLSKK LDPVAAGWPPCLRIMAATAMLVKDSAKLTLGQPLTVITPHTLEAIVQPPDRWITNARLITHYQALLLDTDRVQFGPPVTLNPATLLPVPENQPSHDCR QVLAETHGTREDLKDQELPDADHTWYTDGSSYLDSGTRRAGAAVVDGHNTIWAQSLPPGTSAQKAELIALTKALELSKGKKANIYTDSRYAFATAHTH GSIYERRGLLTSEGKEIKNKAEIIALLKALFLPQEVAIIHCPGHQKGQDPVAVGNRQADRVARQAAMAEVLTLATEPDNTSHIT |
| BAEVM_P10272_3mutA | 8,006 | TVSLQDEHRLFDIPVTTSLPDVWLQDFPQAWAETGGLGRAKCQAPIIIDLKPTAVPVSIKQYPMSLEAHMGIRQHIIKFLELGVLRPCRSPWNTPLLPVK KPGTQDYRPVQDLREINKRTVDIHPTVPNYNLLSTLKPDYSWYTVLDLKDAFFCLPLAPQSQELFAFEWKDPERGISGQLTWTRLPQGFKNSPTLFN EALHRDLTDFRTQHPEVTLLQYVDDLLLAAPTKKACTQGTRHLLQELGEKGYRASAKKAQICQTKVTYLGYILSEGKRWLTPGRIETVARIPPPRNPRE VREFLGKAGFCRLFIPGFAELAAPLYALTMLVKDSAKLTLGQPLTVITPHTLEAIVQPPDRWITNARLITHYQALLLDTDRVQFGPPVTLNPATLLPVPENQPSHDCR QVLAETHGTREDLKDQELPDADHTWYTDGSSYLDSGTRRAGAAVVDGHNTIWAQSLPPGTSAQKAELIALTKALELSKGKKANIYTDSRYAFATAHTH GSIYERRGLLTSEGKEIKNKAEIIALLKALFLPQEVAIIHCPGHQKGQDPVAVGNRQADRVARQAAMAEVLTLATEPDNTSHIT DPVAAGWPPCLRIMAATAMLVKDSAKLTLGQPLTVITPHTLEAIVQPPDRWITNARLITHYQALLLDTDRVQFGPPVTLNPATLLPVPENQPSHDCRQ |

TABLE 6-continued

Exemplary reverse transcriptase domains from retroviruses

| RT Name | SEQ ID NO: | RT amino acid sequence |
|---|---|---|
| BLVAU_P25059 | 8,007 | VLAETHGTREDLKDQELPDADHTWYTDGSSYLDSGTRRAGAAVVDGHNTIWAQSLPPGTSAQKAELIALTKALELSKGKKANIYTDSRYAFATAHTHG SIYERRGWITSEGKEIKNKAEIIALLKALFLPQEVAIIHCPGHQKGQDPVAVNRQADRVARQAAMAEVLTLATEPDNTSHIT |
| BLVAU_P25059_2mut | 8,008 | GVLDAPPSHIGLEHLPPPEVPQFPLNLERLQALQDLVHRSLEAGYISPWDGPGNNPVFPVRKPNGAWRFVHDLRVTNALTKPIPALSPGPPDLTAIPT HLPHIICLDLKDAFFQIPVEDRFRSYFAFTLPTPGGLQPHRRFAWRVLPQGFINSPALFERALQEPLRQVSAAFSQSLLVSMDDILYVSPTEEQRLQCY QTMAAHLRDLGFQVASEKTRQTPSPVPFLGQMVHERMVTYQSLPTLQISSPISLHQLQTVLGDLQWVSRGTPTTRRPLQLLYSSLKGIDDPRAIIHLSP EQQQGIAELRQALSHNARSRYNEQEPLLAYVHLTRAGSTLVLFQKGAQPPLAYFQTPLTDNQASPWGLLLLLGCQYLQAQALSSYAKTILKYYHNLPK TSLDNWIQSSEDPRVQELLQLWPQISSQGIQPPGPWKTLVTRAEVFLTPQFSPEPIPAALCLFSDGAARRGAYCLWKDHLLDFQAVPAPESAQKGELA GLLAGLAAAPPEPLNIWDSKYLYSLLRTLVLGAWLQPDDPVPSYALLYKSLLRHPAIFVGHVRSHSSASHPIASLNNYVDQL |
| BLVJ_P03361 | 8,009 | GVLDTPPSHIGLEHLPPPEVPQFPLNLERLQALQDLVHRSLEAGYISPWDGPGNNPVFPVRKPNGAWRFVHDLRATNALTKPIPALSPGPPDLTAIPT HPPHIICLDLKDAFFQIPVEDRFRFYLSFTLPSPGGLQPHRRFAWRVLPQGFINSPALFERALQEPLRQVSAAFSQSLLVSMDDILYASPTEEQRSQCY QALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPE QLQGIAELRQALSHNARSRYNEQEPLLAYVHLTRAGSTLVLFQKGAQPPLAYFQTPLTDNQASPWGLLLLLGCQYLQTQALSSYAKPILKYYHNLPKTS LDNWIQSSEDPRVQELLQLWPQISSQGIQPPGPWKTLITRAEVFLTPQFSPDDIPAALCLFSDGATGRGAYCLWKDHLLDFQAVPAPESAQKGELAGL LAGLAAAPPEPVNIWDSKYLYSLLRTWVLGAWLQPDPVPSYALLYKSLLRHPAIVVGHVRSHSSASHPIASLNNYVDQL |
| BLVJ_P03361_2mut | 8,010 | GVLDTPPSHIGLEHLPPPEVPQFPLNLERLQALQDLVHRSLEAGYISPWDGPGNNPVFPVRKPNGAWRFVHDLRATNALTKPIPALSPGPPDLTAIPT HPPHIICLDLKDAFFQIPVEDRFRFYLSFTLPSPGGLQPHRRFAWRVLPQGFINSPALFNRALQEPLRQVSAAFSQSLLVSMDDILYASPTEEQRSQCY QALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPE QLQGIAELRQALSHNARSRYNEQEPLLAYVHLTRAGSTLVLFQKGAQPPLAYFQTPLTDNQASPWGLLLLLGCQYLQTQALSSYAKPILKYYHNLPKTS LDNWIQSSEDPRVQELLQLWPQISSQGIQPPGPWKTLITRAEVFLTPQFSPDDIPAALCLFSDGATGRGAYCLWKDHLLDFQAVPAPESAQKGELAGL LAGLAAAPPEPVNIWDSKYLYSLLRTWVLGAWLQPDDPVPSYALLYKSLLRHPAIVVGHVRSHSSASHPIASLNNYVDQL |
| BLVJ_P03361_2mutB | 8,011 | GVLDTPPSHIGLEHLPPPEVPQFPLNLERLQALQDLVHRSLEAGYISPWDGPGNNPVFPVRKPNGAWRFVHDLRATNALTKPIPALSPGPPDLTAPP THPPHIICLDLKDAFFQIPVEDRFRFYLSFTLPSPGGLQPHRRFAWRVLPQGFINSPALFQRALQEPLRQVSAAFSQSLLVSYMDDILYASPTEEBQRSQC YQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSP EQLQGIAELRQALSHNARSRYNEQEPLLAYVHLTRAGSTLVLFQKGAQPPLAYFQTPLTDNQASPWGLLLLLGCQYLQTQALSSYAKPILKYYHNLPKT SLDNWIQSSEDPRVQELLQLWPQISSQGIQPPGPWKTLITRAEVFLTPQFSPDDIPAALCLFSDGATGRGAYCLWKDHLLDFQAVPAPESAQKGELAG LLAGLAAAPPEPVNIWDSKYLYSLLRTWVLGAWLQPDDPVPSYALLYKSLLRHPAIVVGHVRSHSSASHPIASLNNYVDQL |
| FFV_O_93209 | 8,012 | MDLLKPLTVERKGVKIKGYWNSQADITCVPKDLLQGEEPVRQQNVTTIHGTQEGDVYVNLKIDGRRINTEVIGTTLDYAIITPGDVPWILKKPLELTIKLD LEEQQGTLLNNSIILSKKGKEELKQLFEKYSALMQSWENQVGHRRIRPHKIATGTVKPTPQKQYHINPKAKPDIQIVINDLLKQGVLIQKESTMNTPVYPV PKPNGRWMVLDYRAVNKVTPLIAVQNQHSYGILGSLFKGRYKTTIDLSNGFWAHPIVPEDVWITAFTWQGKQYCWTVLPQGFLNSPGLFTGDVDL LQGIPNVEVYVDDVYISHDSEKEHLEYLDILFNRLKEAGYIISLKKSNIANSIVDFLGFQITNEGRGLTDTFKEKLENITAPTTLKQLQSIIGLLNFARNFIPD FTELIAPLYALIPKSTKNYVPWQIEHSTLETLITKLNGAEYLQGRKGDKTLIMKVNASYTTGYIRYNEGEKKPISYVSIVFSKTELKFTELEKLLTTVHKG LLKALDLSMGQNIHVYSPIVSMQNIQKTPQTAKKALASRWLSWLSYLEDPRIRFFYDPQMPALKDLPAVDTGDNKKHPSNFQHIFYTDGSAITSPTKE GHLNAGMGIVYFINKDGNLQKQQEWSISLGNHTAQFEIAAFFALKKCLPLGGNILVVTDSNYVAKAYNEELDVWASNGFVNNRKKPLKHISKWKSV ADLKRLRPDVVVTHEPGHQKLDSSPHAYGNNILADQLATQASFKVH |

TABLE 6-continued

Exemplary reverse transcriptase domains from retroviruses

| RT Name | SEQ ID NO: | RT amino acid sequence |
|---|---|---|
| FFV_O_93209_2mut | 8,013 | MDLLKPLTVERKGVKIKGYWNSQADITCVPKDLLQGEEPVRQQNVTTIHGTQEGDVYVNLKIDGRRINTEVIGTTLDYAIITPGDVPWILKKPLELTIKLD LEEQQGTLLNNSILSKKGKEELKQLFEKYSALMQSWENQVGHRRIRPHKIATGTVKPTPQKQYHINPKAKPDIQIVINDLLKQGVLIQKESTMNTPVYPV PKPNGRWRMVLDYRAVNKVTPLIAVQNQHSYGILGSLFKGRYKTTIDLSNGFWAHPIVPEDYWITAFTWQGKQYCWTLPQGFLNSPGLFNGDVVDL LQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPD FTELIAPLYALIPKSPKNYVPWQIEHSTTLETLITKLNGAEYLQGRKGDKTLIMKVNASYTTGYIRYNEGEKKPISYSIVFSKTELKFTELEKLLTTVHKG LLKALDLSMGQNIHVYSPIVSMQNIQKTPQTAKKALASRWLSWLSYLEDPRIRRFFYDPQMPALKDLPAVDTGKDNKKHPSNFQHIFYTDGSAITSPTKE GHLNAGMGIVYFINKDGNLQKQQEWSISLGNHTAQFAEIAAFEFALKKCLPLGGNILVVTDSNYVAKAYNEELDVWASNGFVNNRKKPLKHISKWKSV ADLKRLRPDVVVTHEPGHQKLDSSPHAYGNNLADQLATQASFKVH |
| FFV_O_93209_2mutA | 8,014 | MDLLKPLTVERKGVKIKGYWNSQADITCVPKDLLQGEEPVRQQNVTTIHGTQEGDVYVNLKIDGRRINTEVIGTTLDYAIITPGDVPWILKKPLELTIKLD LEEQQGTLLNNSILSKKGKEELKQLFEKYSALMQSWENQVGHRRIRPHKIATGTVKPTPQKQYHINPKAKPDIQIVINDLLKQGVLIQKESTMNTPVYPV PKPNGRWRMVLDYRAVNKVTPLIAVQNQHSYGILGSLFKGRYKTTIDLSNGFWAHPIVPEDYWITAFTWQGKQYCWTLPQGFLNSPGLFNGDVVDL LQGIPNVEVYVDDVYISHDSEKEHLEYLDILFNRLKEAGYIISLKKSNIANSIVDFLGFQITNEGRGLTDTFKEKLENITAPTTLKQLQSILGLLNFARNFIPD FTELIAPLYALIPKSPKNYVPWQIEHSTTLETLITKLNGAEYLQGRKGDKTLIMKVNASYTTGYIRYNEGEKKPISVSIVFSKTELKFTELEKLLTTVHKG LLKALDLSMGQNIHVYSPIVSMQNIQKTPQTAKKALASRWLSWLSYLEDPRIRRFFYDPQMPALKDLPAVDTGKDNKKHPSNFQHIFYTDGSAITSPTKE GHLNAGMGIVYFINKDGNLQKQQEWSISLGNHTAQFAEIAAFEFALKKCLPLGGNILVVTDSNYVAKAYNEELDVWASNGFVNNRKKPLKHISKWKSV ADLKRLRPDVVVTHEPGHQKLDSSPHAYGNNLADQLATQASFKVH |
| FFV_O_93209_Pro | 8,015 | VPWILKKPLELTIKLDLEEQQGTLLNNSILSKKGKEELKQLFEKYSALMQSWENQVGHRRIATGTVKPTPQKQYHINPKAKPDIQIVINDLLKQGV LIQKESTMNTPVVPVPKPNGRWRMVLDYRAVNKVTPLIAVQNQHSYGILGSLFKGRYKTTIDLSNGFWAHPIVPEDYWITAFTWQGKQYCWTLPQGF LNSPGLFTGDVVDLLQGIPNVEVYVDDVYISHDSEKEHLEYLDILFNRLKEAGYIISLKKSNIANSIVDFLGFQITNEGRGLTDTFKEKLENITAPTTLKQLQ SILGLLNFARNFIPDFTELIAPLYALIPKSTKNYVPMQIEHSTTLETLITKLNGAEYLQGRKGDKTLIMKVNASYTTGYIRYNEGEKKPISYSIVFSKTELK FTELEKLLTTVHKGLLKALDLSMGQNIHVYSPIVSMQNIQKTPQTAKKALASRWLSWLSYLEDPRIRRFFYDPQMPALKDLPAVDTGKDNKKHPSNFQHI FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR KKPLKHISKWKSVADLKRLRPDVVVTHEPGHQKLDSSPHAYGNNLADQLATQASFKVH |
| FFV_O_93209_Pro_2mut | 8,016 | VPWILKKPLELTIKLDLEEQQGTLLNNSILSKKGKEELKQLFEKYSALMQSWENQVGHRRIATGTVKPTPQKQYHINPKAKPDIQIVINDLLKQGV LIQKESTMNTPVVPVPKPNGRWRMVLDYRAVNKVTPLIAVQNQHSYGILGSLFKGRYKTTIDLSNGFWAHPIVPEDYWITAFTWQGKQYCWTLPQGF LNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQ SILGLLNFARNFIPDFTELIAPLYALIPKSPKNYVPMQIEHSTTLETLITKLNGAEYLQGRKGDKTLIMKVNASYTTGYIRYNEGEKKPISYSIVFSKTELK FTELEKLLTTVHKGLLKALDLSMGQNIHVYSPIVSMQNIQKTPQTAKKALASRWLSWLSYLEDPRIRRFFYDPQMPALKDLPAVDTGKDNKKHPSNFQHI FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR KKPLKHISKWKSVADLKRLRPDVVVTHEPGHQKLDSSPHAYGNNLADQLATQASFKVH |
| FFV_O_93209_Pro_2mutA | 8,017 | VPWILKKPLELTIKLDLEEQQGTLLNNSILSKKGKEELKQLFEKYSALMQSWENQVGHRRIATGTVKPTPQKQYHINPKAKPDIQIVINDLLKQGV LIQKESTMNTPVVPVPKPNGRWRMVLDYRAVNKVTPLIAVQNQHSYGILGSLFKGRYKTTIDLSNGFWAHPIVPEDYWITAFTWQGKQYCWTLPQGF LNSPGLFNGDVVDLLQGIPNVEVYVDDVYISHDSEKEHLEYLDILFNRLKEAGYIISLKKSNIANSIVDFLGFQITNEGRGLTDTFKEKLENITAPTTLKQLQ SILGLLNFARNFIPDFTELIAPLYALIPKSPKNYVPMQIEHSTTLETLITKLNGAEYLQGRKGDKTLIMKVNASYTTGYIRYNEGEKKPISYVSIVFSKTELK FTELEKLLTTVHKGLLKALDLSMGQNIHVYSPIVSMQNIQKTPQTAKKALASRWLSWLSYLEDPRIRRFFYDPQMPALKDLPAVDTGKDNKKHPSNFQHI FYTDGSAITSPTKEGHLNAGMGIVYFINKDGNLQKQQEWSISLGNHTAQFAEIAAFEFALKKCLPLGGNILVVTDSNYVAKAYNEELDVWASNGFVNNR KKPLKHISKWKSVADLKRLRPDVVVTHEPGHQKLDSSPHAYGNNLADQLATQASFKVH |
| FLV_P10273 | 8,018 | TLQLEEEYRLFEPESTQKQEMDIWLKNFPQAWAETGGMGTAHCQAPVLIQLKATATPISIRQYPMPHEAYQGIKPHIRRMLDQGILKPCQSPWNTPLLP VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL FDEALHSGLDLADFRVRYPALVLLQYVDDLLLAAATRTECLEGIKLALLETLGNKGYRASAKKAQICLQEVTYLGYSLKDGQRWLTKARKEAILSIPVPKNSR QVREFLGTAGYCRLWIPGFAELAAPLYPLTRPGTLFQWGTEQQLAFEDIKKALLSSPALGLPDITKPFELFIDENSGFAKGVLVQKLGPWKRPVAYLSK KLDTVASGWPPCLRMVAAIAILVKDAGKLTLGQPLTLITSHPVEALVRQPPNKMLSNARMTHYQAMLLDAERVHFGPTVSLNPATLLPLPSGGNHHDC |

TABLE 6-continued

Exemplary reverse transcriptase domains from retroviruses

| RT Name | SEQ ID NO: | RT amino acid sequence |
|---|---|---|
| FLV_P10273_3mut | 8,019 | LQILAETHGTRPDLTDQPLPDADLTWYTDGSSFIRNGEREAGAAVTTESEVIWAAPLPPGTSAQRAELIALTQALKMAEGKKLTVYTDSRYAFATTHVH GEIYRRGLLTSEGKEIKNKNEILALLEALFLPKRLSIIHCPGHQKGDSPQAKGNRLADDTAKKAATETHSSLTVLP TLQLEEEYRLFEPESTQKQEMDIWLKNFPPQAWAETGGMGTAHCQAPVLIQLKATATPISIRQYPMPHEAYQGIKPHIRRMLDQGILKPCQSPWNTPLLP VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL FNEALHSDLADFRVRYPALVLLQYVDDLLLAATRTECLEGTKALLETLGNKGYRASAKKAQICLQEVTYLGYSLKDGQRWLTKARKEAILSIPVPKNSR QVREFLGTAGYCRLWIPGFAELAAPLYPLTRPGTLFQWGTEQQLAFEDIKKALLSSPALGLPDITKPPELFIDENSGPAKGVLVQKLGPWKRPVAYLSK KLDTVASGWPPCLRMVAAIAILVKDAGKLTLGQPLTILTSHPVEALVRQPPNKWLSNARMTHYQAMLLDAERVHFGPTVSLNPATLLPLPSGGNHHDC LQILAETHGTRPDLTDQPLPDADLTWYTDGSSFIRNGEREAGAAVTTESEVIWAAPLPPGTSAQRAELIALTQALKMAEGKKLTVYTDSRYAFATTHVH GEIYRRGWLTSEGKEIKNKNEILALLEALFLPKRLSIIHCPGHQKGDSPQAKGNRLADDTAKKAATETHSSLTVLP |
| FLV_P10273_3mutA | 8,020 | TLQLEEEYRLFEPESTQKQEMDIWLKNFPPQAWAETGGMGTAHCQAPVLIQLKATATPISIRQYPMPHEAYQGIKPHIRRMLDQGILKPCQSPWNTPLLP VKKPGTEDYRPVQDLREVNKRVEDIHPTVPNPYNLLSTLPPSHPWYTVLDLKDAFFCLRLHSESQLLFAFEWRDPEIGLSGQLTWTRLPQGFKNSPTL FNEALHSDLADFRVRYPALVLLQYVDDLLLAATRTECLEGTKALLETLGNKGYRASAKKAQICLQEVTYLGYSLKDGQRWLTKARKEAILSIPVPKNSR QVREFLGKAGYCRLFIPGFAELAAPLYPLTRPGTLTILTSHPVEALVRQPPNKWLSNARMTHYQAMLLDAERVHFGPTVSLNPATLLPLPSGGNHHDCL LDTVASGWPPCLRMVAAIAILVKDAGKLTLGQPLTILTSHPVEALVRQPPNKWLSNARMTHYQAMLLDAERVHFGPTVSLNPATLLPLPSGGNHHDCL QILAETHGTRPDLTDQPLPDADLTWYTDGSSFIRNGEREAGAAVTTESEVIWAAPLPPGTSAQRAELIALTQALKMAEGKKLTVYTDSRYAFATTHVHG EIYRRGWLTSEGKEIKNKNEILALLEALFLPKRLSIIHCPGHQKGDSPQAKGNRLADDTAKKAATETHSSLTVLP |
| FOAMV_P14350 | 8,021 | MNPLQLIQPLPAEIKGTKLLAHWNSGATITCIPESFLEDEQPIKKTLIKTIHGEKQQNVYVYTFKVGRKVEAEVIASPYEYILLSPTDVPWLTQQPLQLTIL VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV YPVPKPDGRWRMVLDYREVNKTIPLTAAQNQHSAGILATIVRQKYKTTLDLANGFWAHPITPESYWLTAFTWQGKQYCWTRLPQGFLNSPALFTADV VDLLKEIPNVQVYVDDIYLSHDDPKEHVQQLEKVFQILLQAGVVSLKKSEIGQKYTVEFLGFNITKEGRGLTDTFKTLLNITPPKDLKQLQSILGLLNFAR NFIPNFAELVQPLYNLIASAKGKYIEWSEENTKQLNMVIEALNTASNLEERLPEQRLVIKVNTSPSAGYVRYNETGKKPIMYLNVVFSKAELKFSMLEKL LTTMHKALIKAMDLAMGQEILVYSPIVSMTKIQKTPLPERKALPIRWITWMTYLEDPRIQFHYDKTLPELKHIPDVVTSSQSPVKHPSQYEGVFYTDGSAI KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK WKSIAECLSMKPDITIQHEKGISLQIPVFILKGNALADKLATQGSYVVN |
| FOAMV_P14350_2mut | 8,022 | MNPLQLIQPLPAEIKGTKLLAHWNSGATITCIPESFLEDEQPIKKTLIKTIHGEKQQNVYVYTFKVGRKVEAEVIASPYEYILLSPTDVPWLTQQPLQLTIL VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV YPVPKPDGRWRMVLDYREVNKTIPLTAAQNQHSAGILATIVRQKYKTTLDLANGFWAHPITPESYWLTAFTWQGKQYCWTRLPQGFLNSPALFNADV VDLLKEIPNVQVYVDDIYLSHDDPKEHVQQLEKVFQILLQAGVVSLKKSEIGQKTVEFLGFNITKEGRGLTDTFKTKLLNITPPKDLKQLQSILGLLNFAR NFIPNFAELVQPLYNLIAPAKGKYIEWSEENTKQLNMVIEALNTASNLEERLPEQRLVIKVNTSPSAGVVRYNETGKKPIMYLNVVFSKAELKFSMLEKL LTTMHKALIKAMDLAMGQEILVYSPIVSMTKIQKTPLPERKALPIRWITWMTYLEDPRIQFHYDKTLPELKHIPDVVTSSQSPVKHPSQYEGVFYTDGSAI KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK WKSIAECLSMKPDITIQHEKGISLQIPVFILKGNALADKLATQGSYVVN |
| FOAMV_P14350_2mutA | 8,023 | MNPLQLIQPLPAEIKGTKLLAHWNSGATITCIPESFLEDEQPIKKTLIKTIHGEKQQNVYVYTFKVGRKVEAEVIASPYEYILLSPTDVPWLTQQPLQLTIL VPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPV YPVPKPDGRWRMVLDYREVNKTIPLTAAQNQHSAGILATIVRQKYKTTLDLANGFWAHPITPESYWLTAFTWQGKQYCWTRLPQGFLNSPALFNADV VDLLKEIPNVQVYVDDIYLSHDDPKEHVQQLEKVFQILLQAGVVSLKKSEIGQKTVEFLGFNITKEGRGLTDTFKTKLLNITPPKDLKQLQSILGLLNFAR NFIPNFAELVQPLYNLIAPAKGKYIEWSEENTKQLNMVIEALNTASNLEERLPEQRLVIKVNTSPSAGVVRYNETGKKPIMYLNVVFSKAELKFSMLEKL LTTMHKALIKAMDLAMGQEILVYSPIVSMTKIQKTPLPERKALPIRWITWMTYLEDPRIQFHYDKTLPELKHIPDVVTSSQSPVKHPSQYEGVFYTDGSAI KSPDPTKSNNAGMGIVHATYKPEYQVLNQWSIPLGNHTAQMAEIAAVEFACKKALKIPGPVLVITDSFYVAESANKELPYWKSNGFVNNKKKPLKHISK WKSIAECLSMKPDITIQHEKGISLQIPVFILKGNALADKLATQGSYVVN |
| FOAMV_P14350- | 8,024 | VPWLTQQPLQLTILVPLQEYQEKILSKTALPEDQKQQLKTLFVKYDNLMQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGILATIVRQKYKTTLDLANGFWAHPITPESWLTAFTWQGKQYCWTRLPQ |

TABLE 6-continued

Exemplary reverse transcriptase domains from retroviruses

| RT Name | SEQ ID NO: | RT amino acid sequence |
|---|---|---|
| Pro | | GFLNSPALFTADVVDLLKEIPNVQVYDDIYLSHDDPKEHVQQLEKVFQILLQAGYVVSLKKSEIGQKTVEFLGFNITKEGRGLTDTFKTLLNITPPKDLK QLQSILGLLNFARNFIPNFAELVQPLYNLIASAKGKYIEWSEENTKQLNMVIEALNTASNLEERLPEQRLVIKVNTSPSAGVYRYNETGKKPIMYLNYVF SKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPS QYEGVFYTDGSAIKSPDPTKSNNAGMGIVHATYKPEYQVLMQWSIPLGNHTAQMAEIAAVEFACKKALKIPGPVLVITDSFYVAESANKELPYWKSNGF VNNKKKPLKHISKWKSIAECLSMKPDITIQHEKGISLQIPVFILKGNALADDKLATQGSYVIN |
| FOAMV_P14350_Pro_2mut | 8,025 | VPWLTQQPLQLTILVPLQEYQEKILSKTALPEDQKQQLKTLFVKYDNLMQHWENQVGHRKIRPHNIATGDYPPRPQKQYPINPKAPSIQIVIDDLLKQG VLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQ GFLNSPALFNADVVDLLKEIPNVQVYYDDIYLSHDDPKEHVQQLEKVFQILLQAGYVVSLKKSEIGQKTVEFLGFNITKEGRGLTDTFKTLLNITPPKDL KQLQSILGKLNFARNFIPNFAELVQPLYNLIAPAKGKYIEWSEENTKQLNMVIEALNTASNLEERLPEQRLVIKVNTSPSAGVYRYNETGKKPIMYLNYV FSKAELKFPSMLEKILTTMHKALITMKAMDLAMGQEILVYSPIVSMTKIQKTPLPERKALPIRWITWMTYLEDPRIQFHYDKTLPELKHIPDVYTSSQSPVKHP SQYEGVFYTDGSAIKSPDPTKSNNAGMGIVHATYKPEYQVLNQWSIPLGNHTAQMAELIADLKLATQGSYVIN |
| FOAMV_P14350_Pro_2mutA | 8,026 | VPWLTQQPLQLTILVPLQEYQEKILSKTALPEDQKQQLKTLFVKYDNLMQHWENQVGHRKIRPHNIATGDYPPRPQKQYPINPKAPSIQIVIDDLLKQG VLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQ GFLNSPALFNADVVDLLKEIPNVQVYYDDIYLSHDDPKEHVQQLEKVFQILLQAGYVVSLKKSEIGQKTVEFLGFNITKEGRGLTDTFKTLLNITPPKDL KQLQSILGKLNFARNFIPNFAELVQPLYNLIAPAKGKYIEWSEENTKQLNMVIEALNTASNLEERLPEQRLVIKVNTSPSAGVYRYNETGKKPIMYLNYV FSKAELKFPSMLEKILTTMHKALITMKAMDLAMGQEILVYSPIVSMTKIQKTPLPERKALPIRWITWMTYLEDPRIQFHYDKTLPELKHIPDVYTSSQSPVKHP SQYEGVFYTDGSAIKSPDPTKSNNAGMGIVHATYKPEYQVLNQWSIPLGNHTAQMAELIADLKLATQGSYVIN |
| GALV_P21414 | 8,027 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP TLFDEALHRDLAPFRALNPQVVLLQYVDDLLVAAPTYEDCKKGTQKLLQELSKLGYRVSAKKAQLCQREVTVLGYLLKEGKRWLTPARKATVMKIPVP TTPPRQVREFLGTAGFCRLWIPGFASLAAPLYPLTKPSIPFIWTEEHQQAFDHIKKALLSAPALALPDLTKPFTLYIDERAGVARGVLTQTLGPWRRPVAY LSKKLDPVASGWPTCLKAVAAVALLLKDADKLTLGQNTVIASHSLESIVRQPPDRWMTNARMTHYQSLLLNERVSFAPPAVLNPATLLPVESEATPVH RCSEILAETGTRRDLEDQPLPGVPTWTDGSSFITEGKRRAGAPIVDGKRTVWASSLPEGTSAQKAELVALTQALRLAEGKNINIYTDSRYAFATAHIH GAIYKQRGLLTSAGKDIKNKEEILALLEAIHLPRRVAIIHCPGHQRGSNPVATGNRRADEAAKQAALSTRVLAGTTKP |
| GALV_P21414_3mut | 8,028 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP TLFNEALHRDLAPFRALNPQVVLLQYVDDLLVAAPTYEDCKKGTQKLLQELSKLGYRVSAKKAQLCQREVTVLGYLLKEGKRWLTPARKATVMKIPVP TTPPRQVREFLGTAGFCRLFIPGFASLAAPLPLTKPSIPFIWTEEHQQAFDHIKKALLSAPALALPDLTKPFTLYIDERAGVARGVLTQTLGPWRRPVAY LSKKLDPVASGWPTCLKAVAAVALLLKDADKLTLGQNTVIASHSLESIVRQPPDRWMTNARMTHYQSLLLNERVSFAPPAVLNPATLLPVESEATPVH RCSEILAETGTRRDLEDQPLPGVPTWTDGSSFITEGKRRAGAPIVDGKRTVWASSLPEGTSAQKAELVALTQALRLAEGKNINIYTDSRYAFATAHIH GAIYKQRGWLTSAGKDIKNKEEILALLEAIHLPRRVAIIHCPGHQRGSNPVATGNRRADEAAKQAALSTRVLAGTTKP |
| GALV_P21414_3mutA | 8,029 | VLNLEEEYRLHEKPVPSSIDPSWLQLFPTVWAERAGMGLANQVPPVVVELRSGASPVAVRQYPMSKEAREGIRPHIQKFLDLGVLVPCRSPWNTPLL PVKKPGTNDYRPVQDLREINKRVQDIHPTVPNPYNLLSSLPPSYTWYSVLDLKDAFFCLRLHPNSQPLFAFEWKDPEKGNTGQLTWTRLPQGFKNSP TLFNEALHRDLAPFRALNPQVVLLQYVDDLLVAAPTYEDCKKGTQKLLQELSKLGYRVSAKKAQLCQREVTVLGYLLKEGKRWLTPARKATVMKIPVP TTPPRQVREFLGKAGFCRLFIPGFASLAAVALLLKDADKLTLGQNTVIASHSLESIVRQPPDRWMTNARMTHYQSLLLNERVSFAPPAVLNPATLLPVESEATPVH SKKLDPVASGWPTCLKAVAVALLLKDADKLTLGQNTVIASHSLESIVRQPPDRWMTNARMTHYQSLLLNERVSFAPPAVLNPATLLPVESEATPVH RCSEILAETGTRRDLEDQPLPGVPTWTDGSSFITEGKRRAGAPIVDGKRTVWASSLPEGTSAQKAELVALTQALRLAEGKNINIYTDSRYAFATAHIH GAIYKQRGWLTSAGKDIKNKEEILALLEAIHLPRRVAIIHCPGHQRGSNPVATGNRRADEAAKQAALSTRVLAGTTKP |
| HTL1A_P03362 | 8,030 | AVLGLEHLPRPPQISQPFLNPERLQALQLHLVRKALEAGHIEPYTGPGNNPVPVVKKANGTWRFIHDLRATNSLTIDLSSSPGPPDLSSLPTTLAHLQTI DLRDAFFQIPLPKFQPYPAFTVPQQCNYGPGTRYAWKVLPQGFKNSPTLFEMQLAHILQPIRQAFPQCTILQYMDDLLLASPSHEDLLLLSEATMASLI |

TABLE 6-continued

Exemplary reverse transcriptase domains from retroviruses

| RT Name | SEQ ID NO: | RT amino acid sequence |
|---|---|---|
| HTL1A_P03362_2mut | 8,031 | SHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQL<br>RQALSQNCRSRLVQTLPLLGAIMLTLTGTTVVFQSKEQWPLVWLHAPLPHTSQCPWGQLLASAVLLLDKYTLQSYGLLCQTIHHNISTQTFNQFIQTS<br>DHPSVPIILHHSRFKNLGAQTGELWNTFLKTAAPLAPVKALMPVFTLSPVIINTAPCLFSDGSTSRAAYILMDKQILSQRSFPLPPPHKSAQRAELLGLL<br>HGLSSARSWRCLNIFLDSKYLYHYLRTLALGTFQGRSSQAPFQALLPRLLSRKVVYLHHVRSHTNLPDPISRLNALTDALLITPVLQL |
| HTL1A_P03362_2mutB | 8,032 | AVLGLEHLPRPPQISQPPLNPERLQALQHLVRKALEAGHIEPYTGPGNNPVFPVKKANGTWRFIHDLRATNSLTIDLSSSSPGPPDLSSPPTTLAHLQTI<br>DLRDAFFQIPLPKQFQPYFAFTVPQQCNYGPGTRYAWKVLPQGFKNSPTLFQMQLAHILQPIRQAFPQCTILQYMDDILLASPSHEDLLLLSEATMASLI<br>SHGLPVSENKTQQTPGTIKFLGQIISPNHLTYDAVPTVPIRSRWALPELQALLGEIQWVSKGTPTLRQPLHSLYCALQPHTDPRDQIYLNPSQVQSLVQL<br>RQALSQNCRSRLVQTLPLLGAIMLTLTGTTVVFQSKEQWPLVWLHAPLPHTSQCPWGQLLASVLLLDKYTLQSYGLLCQTIHHNISTQTFNQFIQTS<br>DHPSVPIILHHSRFKNLGAQTGELWNTFLKTAPLAPVKALMPVFTLSPVIINTAPCLFSDGSTSRAAYILMDKQILSQRSFPLPPPHKSAQRAELLGLL<br>HGLSSARSWRCLNIFLDSKYLYHYLRTLALGTFQGRSSQAPFQALLPRLLSRKVVYLHHVRSHTNLPDPISRLNALTDALLITPVLQL |
| HTL1C_P14078 | 8,033 | AVLGLEHLPRPPEISQPPLNPERLQALQHLVRKALEAGHIEPYTGPGNNPVFPVKKANGTWRFIHDLRATNSLTIDLSSSSPGPPDLSSLPTTLAHLQTI<br>DLKDAFFQIPLPKQFQPYFAFTVPQQCNYGPGTRYAWMRVLPQGFKNSPTLFEMQLAHILQPIRQAFPQCTILQYMDDILLASPHADLQLLSEATMASLI<br>SHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQL<br>RQALSQNCRSRLVQTLPLLGAIMLTLTGTTVVFQSKQQWPLVWLHAPLPHTSQCPWGQLLASAVLLLDKYTLQSYGLLCQTIHHNISTQTFNQFIQTS<br>DHPSVPIILHHSRFKNLGAQTGELWNTFLKTAPLAPVKALMPVFTLSPVIINTAPCLFSDGSTSQAAYILMDKHILSQRSFPLPPPHKSAQRAELLGLL<br>HGLSSARSWRCLNIFLDSKYLYHYLRTLALGTFQGRSSQAPFQALLPRLLSRKVVYLHHVRSHTNLPDPISRLNALTDALLITPVLQL |
| HTL1C_P14078_2mut | 8,034 | AVLGLEHLPRPPEISQPPLNPERLQALQHLVRKALEAGHIEPYTGPGNNPVFPVKKANGTWRFIHDLRATNSLTIDLSSSSPGPPDLSSLPTTLAHLQTI<br>DLKDAFFQIPLPKQFQPYFAFTVPQQCNYGPGTRYAWMRVLPQGFKNSPTLFEMQLAHILQPIRQAFPQCVILQYMDDILLASPSHADLQLLSEATMASLI<br>SHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQL<br>RQALSQNCRSRLVQTLPLLGAIMLTLTGTTVVFQSKQQWPLVWLHAPLPHTSQCPWGQLLASAVLLLDKYTLQSYGLLCQTIHHNISTQTFNQFIQTS<br>DHPSVPIILHHSRFKNLGAQTGELWNTFLKTAPLAPVKALMPVFTLSPVIINTAPCLFSDGSTSQAAYILMDKHILSQRSFPLPPPHKSAQRAELLGLL<br>HGLSSARSWRCLNIFLDSKYLYHYLRTLALGTFQGRSSQAPFQALLPRLLSRKVVYLHHVRSHTNLPDPISRLNALTDALLITPVLQL |
| HTL1L_P0C211 | 8,035 | GLEHLPRPPEISQPPLNPERLQALQHLVRKALEAGHIEPYTGPGNNPVFPVKKANGTWRFIHDLRATNSLTVDLSSSSPGPPDLSSLPTTLAHLQTIDLK<br>DAFFQIPLPKQFQPYFAFTVPQQCNYGPGTRYAMKVLPQGFKNSPTLFEMQLASILQPIRQAFPQCVILQYMDDILLASPSPEDLQQLSEATMASLISH<br>GLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQ<br>QALSQNCRSRLAQTLPLLGAIMLTLTGTTVVFQSKQQWPLVWLHAPLPHTSQCPWGQLLASALTPVFTLSPIINTAPCLFSDGSTSQAAYILMDKHILSQRSFPLPPPHKSAQQAELLGLLH<br>GLSSARSWHCLNIFLDSKYLYHYLRTLAWGTFQGKSSQAPFQALLPRLLAHKVIYLHHVRSHTNLPDPISKLNALTDALLITPIL |
| HTL1L_P0C211_2mut | 8,036 | GLEHLPRPPEISQPPLNPERLQALQHLVRKALEAGHIEPYTGPGNNPVFPVKKANGTWRFIHDLRATNSLTVDLSSSSPGPPDLSSLPTTLAHLQTIDLK<br>DAFFQIPLPKQFQPYFAFTVPQQCNYGPGTRYAMKVLPQGFKNSPTLFQMQLASILQPIRQAFPQCVILQYMDDILLASPSPEDLQQLSEATMASLISH<br>GLPVSQDKTQQTPGTIKFLGQIISPNHITYDAVPTVPIRSRWALPELQALLGEIQWVSKGTPTLRQPLHSLYCALQGHTDPRDQIYLNPSQVQSLMQLQ<br>QALSQNCRSRLAQTLPLLGAIMLTLTGTTVVFQSKQQWPLVWLHAPLPHTSQCPWGQLLASALTPVFTLSPIINTAPCLFSDGSTSQAAYILMDKHILSQRSFPLPPPHKSAQQAELLGLLH<br>GLSSARSWHCLNIFLDSKYLYHYLRTLAWGTFQGKSSQAPFQALLPRLLAHKVIYLHHVRSHTNLPDPISKLNALTDALLITPIL |

TABLE 6-continued

Exemplary reverse transcriptase domains from retroviruses

| RT Name | SEQ ID NO: | RT amino acid sequence |
|---|---|---|
| HTL1L_P0C211_2mutB | 8,037 | GLEHLPRPEISQPPLNPERLQALQHLVRKALEAGHIEPYTGPGNNPVFPVKKANGTWRFIHDLRATNSLTVDLSSSPGPPDLSSPPTTLAHLQTIDLK DAFFQIPLPKQFQPYFAFTVPQQCNYGPGTRYAWKVLPQGFKNSPTLFQMQLASILQPIRQARPQCVLQYMDDILLASPEDLQQLSEATMASLLSH GLPVSQDKTQQTPGTIKFLGQIISPNHITYDAVPTVPIRSRWALPELQALLGEIQWVSKGTPTLRQPIHSLYCALQGHTDPRDQIYLNPSQVQSLMQLQ QALSQNCRSRLAQTLPLLGAIMLTLTGTTTVVFQSKQQWPLVWLHAPLPHTSQCPWGQLLASAVLLLDKYTLQSYGLLCQTIHHNISIQTFNQFIQTSD HPSVPIILHHSHRFKNLGAQTGELWNTFLKTAAPLAPVKALITVFTLSPIIINTAPCLFSDGSTSQAAYILWDKHILSQRSFPLPPHKSAQQAELIGLLH GLSSARSWHCLNIFLDSKYLYHYLRTLLAWGTFQGKSSQAPFQALLPRLLAHKVIYLHVRSHTNLPDPISKLNALTDALLITPIL |
| HTL32_Q0R5R2 | 8,038 | GLEHLPPPPEVSQPPLNPERLQALTDLVSRALEAKHIEPYQGPGNNPIFPVKKPNGKWRFIHDLRATNSVTRDLASPSPGPPDLTSLPQGLPHLRTIDLT DAFFQIPLPTIFQPYFAFTLPQPNNYGPGTRYSWRVLPQGFKNSPTLFEQQLSHILTPVRKTFPNSLLIQYMDDIILASPAPGELAALTDKVTNALTKEGL PLSPEKTQATPGFIHFLGQVISQDCITYETLPSINVKSTWSLAELQSMLGELQWYSKGTPVLRSSLHQLYLALRGHRDPRDTIKLTSIQVQALRTIQKALT LNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSV AILLQHSRFHNLGAQPSGPWRSLLQMPQIFQNIDVLRPPFTISPVVINHAPCLFSDGSASKAAFIIWDRQVIHQQVLSLPSTCSAQAGELFGLLAGLQK SQPWVALNIFLDSKFLIGHLRRMALGAFPGPSTQCELHTQLLPLLQGKTVVHHVRSHTLLQDPISRLNEATDALMLAPLLPL |
| HTL32_Q0R5R2_2mut | 8,039 | GLEHLPPPPEVSQPPLNPERLQALTDLVSRALEAKHIEPYQGPGNNPIFPVKKPNGKWRFIHDLRATNSVTRDLASPSPGPPDLTSLPQGLPHLRTIDLT DAFFQIPLPTIFQPYFAFTLPQPNNYGPGTRYSWRVLPQGFKNSPTLFQQQLSHILTPVRKTFPNSLLIQYMDDIILASPAPGELAALTDKVTNALTKEGL PLSPEKTQATPGFIHFLGQVISQDCITYETLPSINVKSTWSLAELQSMLGELQWYSKGTPVLRSSLHQLYLALRGHRDPRDTIKLTSIQVQALRTIQKALT LNCRSRLVNQLPILALIMLRPTGTTAVLFQTKQKWPLVWLHTPHPATSLRPWGQLLANAVIILDKYSLQHYGQVCKSFHHNISNQALTYYLHTSDQSSV AILLQHSRFHNLGAQPSGPWRSLLQMPQIFQNIDVLRPPFTISPVVINHAPCLFSDGSASKAAFIIWDRQVIHQQVLSLPSTCSAQAGELFGLLAGLQ SQPWVALNIFLDSKFLIGHLRRMAWGAFPGPSTQCELHTQLLPLLQGKTVVHHVRSHTLLQDPISRLNEATDALMLAPLLPL |
| HTL32_Q0R5R2_2mutB | 8,040 | GLEHLPPPPEVSQPPLNPERLQALTDLVSRALEAKHIEPYQGPGNNPIFPVKKPNGKWRFIHDLRATNSVTRDLASPSPGPPDLTSPQGLPHLRTIDL TDAFFQIPLPTIFQPYFAFTLPQPNNYGPGTRYSWRVLPQGFKNSPTLFEQQLSHILTPVRKTFPNSLLIQYMDDIILASPAPGELAALTDKVTNALTKEG LPLSPEKTQATPGFIHFLGQVISQDCITYETLPSINVKSTWSLAELQSMLGELQWYSKGTPVLRSSLHQLYLALRGHRDPRDTIKLTSIQVQALRTIQKAL TLNCRSRLVNQLPILALIMLRPTGTTAVLFQTKQKWPLVWLHTPHPATSLRPWGQLLANAVIILDKYSLQHYGQVCKSFHHNISNQALTYYLHTSDQSS VAILLQHSRFHNLGAQPSGPWRSLLQMPQIFQNIDVLRPPFTISPVVIDHAPCLFSDGATSKAAFILWDKQVIHQQVLPSTCSAQAGELFGLLAGLQ KSQPWVALNIFLDSKFLIGHLRRMAWGAFPGPSTQCELHTQLLPLLQGKTVVHHVRSHTLLQDPISRLNEATDALMLAPLLPL |
| HTL3P_Q4U0X6 | 8,041 | GLEHLPPPPEVSQPPLNPERLQALTDLVSRALEAKHIEPYQGPGNNPIFPVKKPNGKWRFIHDLRATNSLTRDLASPSPGPPDLTSLPQDLPHLRTIDLT DAFFQIPLPAVFQPYFAFTLPQPNNHGPGTRYSWRVLPQGFKNSPTLFEQQLSHILAPVRKAFPNSLLIQYMDDIILASPALRELTALTDKVTNALTKEGL PMSLEKTQATPGSIHFLGQVISPDCITYETLPSIHVKSIWSLAELQSMLGELQWVSKGTPVLRSSLHQLYLALRGHRDPRDTIELTSTQVQALKTIQKAL LNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAIL LQHSRFHNLGAQPSGPWRSLLQVPQIFQNIDVLRPPFIISPVVIDHAPCLFSDGATSKAAFILWDKQVIHQQVLPLPSTCSAQAGELFGLLAGLAQK SKP WPALNIFLDSKFLIGHLRRMAWGAFLGPSTQCDLHARLFPLLQGKTVVHHVRSHTLLQDPISRLNEATDALMLAPLLPL |
| HTL3P_Q4U0X6_2mut | 8,042 | GLEHLPPPPEVSQPPLNPERLQALTDLVSRALEAKHIEPYQGPGNNPIFPVKKPNGKWRFIHDLRATNSLTRDLASPSPGPPDLTSLPQDLPHLRTIDLT DAFFQIPLPAVFQPYFAFTLPQPNNHGPGTRYSWRVLPQGFKNSPTLFQQQLSHILAPVRKAFPNSLLIQYMDDIILASPALRELTALTDKVTNALTKEG LPMSLEKTQATPGSIHFLGQVISPDCITYETLPSIHVKSIWSLAELQSMLGELQWVSKGTPVLRSSLHQLYLALRGHRDPRDTIELTSTQVQALKTIQKAL ALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAI LLQHSRFHNLGAQPSGPWRSLLQVPQIFQNIDVLRPPFIISPVVIDHAPCLFSDGATSKAAFILWDKQVIHQQVLPLPSTCSAQAGELFGLLAGLAQKSK PWPALNIFLDSKFLIGHLRRMAWGAFLGPSTQCDLHARLFPLLQGKTVVHHVRSHTLLQDPISRLNEATDALMLAPLLPL |
| HTL3P_Q4U0X6_2mutB | 8,043 | GLEHLPPPPEVSQPPLNPERLQALTDLVSRALEAKHIEPYQGPGNNPIFPVKKPNGKWRFIHDLRATNSLTRDLASPSPGPPDLTSPPQDLPHLRTIDLT DAFFQIPLPAVFQPYFAFTLPQPNNHGPGTRYSWRVLPQGFKNSPTLFEQQLSHILAPVRKAFPNSLLIQYMDDIILASPALRELTALTDKVTNALTKEG LPMSLEKTQATPGSIHFLGQVISPDCITYETLPSIHVKSIWSLAELQSMLGELQWVSKGTPVLRSSLHQLYLALRGHRDPRDTIELTSTQVQALKTIQKAL ALNCRSRLVSQLPILALIILRPTGTTAVLFQTKQKWPLVWLHTPHPATSLRPWGQLLANAIITLDKYSLQHYGQICKSFHHNISNQALTYYLHTSDQSSVAI |

TABLE 6-continued

Exemplary reverse transcriptase domains from retroviruses

| RT Name | SEQ ID NO: | RT amino acid sequence |
|---|---|---|
| HTLV2_P03363_2mut | 8,044 | LLQHSHRPHNLGAQPSGPWRSLLQVPQIFQNIDVLRPPFIISPVVIDHAPCLFSDGATSKAAPILWDKQVIHQQVLPLPSTCSAQAGELFGLLAGLQKSK PWPALNIFLDSKFLIGHLRRMAWGAFLGPSTQCDLHARLFPLLQGKTVYHVRSHTLLQDPISRLNEATDAIMLAPLLPL |
| JSRV_P31623_2mutA | 8,045 | HLPPPPQVDQFPLNLPERLQALNDLVSKALEAGHIEPYSGPGNNPVFPVKKPNGKWRFIHDLRATNAITTTLTSPSPGPPDLTSLPTALPHLQTIDLTDA FPQIPLPKQYQPYFAFTIPQPCNYGPGTRYAMTVLPQCKFNSPTLFQQQLAAVLNPMRKMFPTSTIVQYMDDILLASPTNEELQQLSLQTLQALTTHGL PISQEKTQQTPGQIRFLGQVISPNHITYESTPTPIKSQMTLTELQVIGEIQMVSKGTPILRKHLQSLYSSALHPYRDPRACTLTPQQLHALHAIQQALQH NCRGRLNPALPLLGLISLSTSGTTSVIFQPKQNWPLAMLHTPHPPTSLCPWGHLLACTILTLDKYTLQHYGQLCQSFHHNMSKQALCDFLRNSPHPSV GILIHHMGRFHNLGSQPSGPWKTLLHLPTLLQPRLLRPIFPTLSPVVLDTAPCLFSDGSPQKAAYVLWDQTILQQDITPLPSHETHSAQKGELLALICGLR AAKPWPSLNIFLDSKYLIKYLHSLAIGAFLGTSAHQTIQAALPPLLQGKTIYLHHVRSHTNLPDPISTFNEYTDSLIIAPLVPL |
| JSRV_P31623_2mutB | 8,046 | PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPT PSAIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLL YQAFSILKQHLSLNGLVIADEKIQTHHFPYNYLGFSLYPRVYNTQLVKLQTDHLKTLNDFQKLLGDINWIRPYLKLPTYTLQPLFDILKGDSDPASPRTLSLE GRTALQSIEEAIRQQQITYCDYQRSWGLYILPTPRAPTGVLYQDKPLRMIYLSATPTKHLLPYYELVAKIIAKGRHEAIQYFGMEPPFICVPYALEQQDWL FQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNL FTDSSYYVGALQMIETVPIIGTTSPEVLNLFTLIQVLHCRQHPCFFGHIRAHSTLPGALVQGNHTADVLTKQVFFQS |
| KORV_Q9TTC1_2mut | 8,047 | PLGTSDSPVTHADPIDWKSEEPVWVDQWPLTQEKLSAAQQLVQEQLRLGHIEPSTSAWNSPIFVIKKKSGKWRLLQDLRKVNETMMHMGALQPGLPT PSPIPDKSYIIVIDLKDCFYTIPLAPQDCKRFAFSLPSVNFKEPMQRYQWRVLPQGMTNSPTLCQKFVATAIAPVRQRFPQLYLVHYMDDILLAHTDEHLL YQAFSILKQHLSLNGLVIADEKIQTHHFPYNYLGFSLYPRVYNTQLVKLQTDHLKTLNDFQKLLGDINWIRPYLKLPTYTLQPLFDILKGDSDPASPRTLSLE GRTALQSIEEAIRQQQITYCDYQRSWGLYILPTPRAPTGVLYQDKPLRMIYLSATPTKHLLPYYELVAKIIAKGRHEAIQYFGMEPPFICVPYALEQQDWL FQFSDNWSIAFANYPGQITHHYPSDKLLQFASSHAFIFPKIVRRQPIPEATLIFTDGSSNGTAALIINHQTYYAQTSFSSAQVVELFAVHQALLTVPTSFNL FTDSSYYVGALQMIETVPIIGTTSPEVLNLFTLIQVLHCRQHPCFFGHIRAHSTLPGALVQGNHTADVLTKQVFFQS |
| KORV_Q9TTC1_3mut | 8,048 | TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLT KLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGI RPHIQRFLDLGIIVPCQSPWNTPLLPVKKPGTNDYRPVQDLREVNKRVQDIHPTVPNPYNLLSSLPPSHTWYSVLDLKDAFFCLKLHPNSQPLFAFEW RDPEKGNTGQLTWTRLPQGFKNSPTLFNEALHRDLASPRALNPQVVMLQYVDDLLVAAPTYRDCKEGTRRLLQELSKLGYRVSAKKAQLCREEVTYL GYLLKGGKRWLTPARKATVMKIPTPTTPRQVREFLGTAGFCRLWIPGFASLAAPLYPLTREKVPFTWTEAHQEAFGRIKEALLSAPALALPDLTKPFAL YVDEKEGVARGVLTQTLGPWRRPVAYLSKKLDPVASGWPTCLKAIAAVALLKDADKLTLGQNVLVIAPHNLESIVRQPPDRWMTNARMTHYQSLLLN ERVSFAPPAILNPATLLPVESDDTPIHICSEILAEETGTRPDLRDQPLPGVPAWYTDGSSFIMDGRRQAGAAIVDNKRTVWASNLPGTSAQKAELIALT QALRLAEGKSINIYTDSRYAFATAHVHGAIYKQRGLLTSAGKDIKNKEEILALLEAIHLPKRVAIIHCPGHQRGTDPVATGNRKADEAAKQAAQSTRILTET TKN |
| KORV_Q9TTC1_3mutA | 8,049 | TLGDQGSRGSDPLPEPRVTLTVEGIPTEFLVNTGAEHSVLTKPMGKMGSKRTVVAGATGSKVYPWTTKRLLKIGQKQVTHSFLVIPECPAPLLGRDLLT KLKAQIQFSTEGPQVTWEDRPAMCLVLNLEEEYRLHEKPVPPSIDPSWLQLFPMVWAEKAGMGLANQVPPVVVELKSDASPVAVRQYPMSKEAREGI RPHIQRFLDLGIIVPCQSPWNTPLLPVKKPGTNDYRPVQDLREVNKRVQDIHPTVPNPYNLLSSLPPSHTWYSVLDLKDAFFCLKLHPNSQPLFAFEW RDPEKGNTGQLTWTRLPQGFKNSPTLFNEALHRDLASPRALNPQVVMLQYVDDLLVAAPTYRDCKEGTRRLLQELSKLGYRVSAKKAQLCREEVTYL GYLLKGGKRWLTPARKATVMKIPTPTTPRQVREFLGTAGFCRLWIPGFASLAAPLYPLTRPKVPFTWTEAHQEAFGRIKEALLSAPALALPDLTKPFAL YVDEKEGVARGVLTQTLGPWRRPVAYLSKKLDPVASGWPTCLKAIAAVALLLKDADKLTLGQNVLVIAPHNLESIVRQPPDRWMTNARMTHYQSLLLN ERVSFAPPAILNPATLLPVESDDTPIHICSEILAEETGTRPDLRDQPLPGVPAWYTDGSSFIMDGRQAGAAIVDNKRTVWASNLPGTSAQKAELIALT QALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTE TTKN |

TABLE 6-continued

Exemplary reverse transcriptase domains from retroviruses

| RT Name | SEQ ID NO: | RT amino acid sequence |
|---|---|---|
| KORV_Q9TTC1-Pro | 8,050 | GYLLKGGKRWLTPARKATVMKIPTPTPRQVREFLGKAGFCRLFIPGFASLAAPLYPLTRPKVPFTWTEAHQEAFGRIKEALLSAPALALPDLTKPFALY VDEKEGVARGVLTQTLGPWRRPVAYLSKKLDPVASGWPTCLKAIAAVALLLKDADKLTGQNVLVIAPHNLESIVRQPPDRWMTNARMTHYQSLLLNE RVSFAPPAILNPATLLPVESDDTPIHICSEILAEETGTRPDLRDQPLPGVPAWYTDGSSFIMDGRRQAGAAIVDNKRTVWASNLPEGTSAQKAELIALTQ ALRLAEGKSINIYTDSRYAFATAHVHGAIYKQRGWLTSAGKDIKNKEEILALLEAIHLPKRVAIIHCPGHQRGTDPVATGNRKADEAAKQAAQSTRILTET TKN |
| KORV_Q9TTC1-Pro_3mut | 8,051 | LLGRDLLTKLKAQIQFSTEGPQVTWEDRPAMCLVLNLEEEYRLHEKPVPPSIDPSWLQLFPMWAEKAGMGLANQVPPVVELKSDASPVAVRQYPM SKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQ PLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLC REEVTYLGVLLKGGKRWLTPARKATVMKIPTPTPRQVREFLGTAGFCRLWIPGFASLAAPLYPLTREKVPFTWTEAHQEAFGRIKEALLSAPALALPD LTKPFALYVDEKEGVARGVLTQTLGPWRRPVAYLSKKLDPVASGWPTCLKAIAAVALLLKDADKLTLGQNVLVIAPHNLESIVRQPPDRWMTNARMTH YQSLLLNERVSFAPPAILNPATLLPVESDDTPIHICSEILAEETGTRPDLRDQPLPGVPAWYTDGSSFIMDGRRQAGAAIVDNKRTVWASNLPEGTSAQ KAELIALTQALRLAEGKSINIYTDSRYAFATAHVHGAIYKQRGLLTSAGKDIKNKEEILALLEAIHLPKRVAIIHCPGHQRGTDPVATGNRKADEAAKQAAQ STRILTETTKN |
| KORV_Q9TTC1-Pro_3mutA | 8,052 | LLGRDLLTKLKAQIQFSTEGPQVTWEDRPAMCLVLNLEEEYRLHEKPVPPSIDPSWLQLFPMWAEKAGMGLANQVPPVVELKSDASPVAVRQYPM SKEAREGIRPHIQRFLDLGILVPCQSPWNTPLLPVKKPGTNDYRPVQDLREVNKRVQDIHPTVPNPYNLLSSLPPSHTWYSVLDLKDAFFCLKLHPNSQ PLFAFEWRDPEKGNTGQLTWTRLPQGFKNSPTLFNEALHRDLASFRALNPQVVMLQYVDDLLVAAPTYRDCKEGTRRLLQELSKLGYRVSAKKAQLC REEVTYLGVLLKGGKRWLTPARKATVMKIPTPTPRQVREFLGTAGFCRLFIPGFASLAAPLYPLTRPKVPFTWTEAHQEAFGRIKEALLSAPALALPDL TKPFALYVDEKEGVARGVLTQTLGPWRRPVAYLSKKLDPVASGWPTCLKAIAAVALLLKDADKLTLGQNVLVIAPHNLESIVRQPPDRWMTNARMTHY QSLLLNERVSFAPPAILNPATLLPVESDDTPIHICSEILAEETGTRPDLRDQPLPGVPAWYTDGSSFIMDGRRQAGAAIVDNKRTVWASNLPEGTSAQK AELIALTQALRLAEGKSINIYTDSRYAFATAHVHGAIYKQRGWLTSAGKDIKNKEEILALLEAIHLPKRVAIIHCPGHQRGTDPVATGNRKADEAAKQAAQ STRILTETTKN |
| MLVAV_P03356 | 8,053 | TLNLEDEYRLYETSAEPEVSPGSTWLSDFPQAWAETGMGLAVRQAPLIIPLKATSTPVSIKQYPMSQEAKLGIKPHIQRLLDQGILVPCQSPWNTPLL PVKKPGTNDYRPVQDLREVNKRVEDIHPTVPNPYNLLSGLPPSHRWYTVLDLKDAFFCLRLHPTSQPLFAFEWRDPGMGISQQLTWTRLPQGFKNSP TLFDEALHRDLADFRIQHPDLILLQYVDDILLAATSELDCQQGTRALLLTLGNLGYRASAKKAQLCQKQVKYLGYLLKEGQRWLTEARKETVMGQPTPK TPRQLREFLGTAGFCRLWIPGFAEMAAPLYPLTKTGLTFNWGPDQQKAYQEIKQALLTAPALGLPDLTKPFELFVDEKQGYAKGVLTQKLGPWRRPVA YLSKKLDPVAAGWPPCLRMVAAIAVLRKDAGKLTMGQPLVIIAPHAVEALVKQPPDRWLSNARMTHYQAMLLDTDRVQFGPVVALNPATLLPLPEEG APHDCLEILAETHGTRPDLTDQPIPDADHTWYTDGSSFLQEGQRKAGAAVTTETEVIWARALPAGTSAQRAELIALTQALKMAEGKRLNVYTDSRYAF ATAHIHGEIYRRRGLLTSEGREIKNKSEILALLKALFLPKRLSIIHCLGHQKGDSAEARGNRLADQAAREAAIKTPDTSTLL |
| MLVAV_P03356_3mut | 8,054 | TLNLEDEYRLYETSAEPEVSPGSTWLSDFPQAWAETGMGLAVRQAPLIIPLKATSTPVSIKQYPMSQEAKLGIKPHIQRLLDQGILVPCQSPWNTPLL PVKKPGTNDYRPVQDLREVNKRVEDIHPTVPNPYNLLSGLPPSHRWYTVLDLKDAFFCLRLHPTSQPLFAFEWRDPGMGISQQLTWTRLPQGFKNSP TLFNEALHRDLADFRIQHPDLILLQYVDDILLAATSELDCQQGTRALLLTLGNLGYRASAKKAQLCQKQVKYLGYLLKEGQRWLTEARKETVMGQPTPK TPRQLREFLGTAGFCRLWIPGFAEMAAPLYPLTKTGLTFNWGPDQQKAYQEIKQALLTAPALGLPDLTKPFELFVDEKQGYAKGVLTQKLGPWRRPV AYLSKKLDPVAAGWPPCLRMVAAIAVLRKDAGKLTMGQPLVIIAPHAVEALVKQPPDRWLSNARMTHYQAMLLDTDRVQFGPVVALNPATLLPLPEE GAPHDCLEILAETHGTRPDLTDQPIPDADHTWYTDGSSFLQEGQRKAGAAVTTETEVIWARALPAGTSAQRAELIALTQALKMAEGKRLNVTDSRYA FATAHIHGEIYRRRGWLTSEGREIKNKSEILALLKALFLPKRLSIIHCLGHQKGDSAEARGNRLADQAAREAAIKTPDTSTLL |

TABLE 6-continued

Exemplary reverse transcriptase domains from retroviruses

| RT Name | SEQ ID NO: | RT amino acid sequence |
|---|---|---|
| MLVAV_P03356_3mutA | 8,055 | TLNLEDEYRLYETSAEPEVSPGSTWLSDFPQAWAETGMGLAVRQAPLIIPLKATSTPVSIKQYPMSQEAKLGIKPHIQRLLDQGILVPCQSPWNTPLL PVKKPGTNDYRPVQDLREVNKRVEDIHPTVPNYNLLSGLPPSHRWYTVLDLKDAFFCLRLHPTSQPLFAFEWRDPGMGISGQLTWTRLPQGFKNSP TLFNEALHRDLADFRIQHPDLILLQYVDDILLAATSELDCQQGTRALLLTLGNLGYRASAKKAQLCQKQVKYLGYLLKEGQRWLTEARKETVMGQPTPK TPRQLREFLGKAGFCRLFIPGFAEMAAPLYPLTKPGTLRFNWGPDQQKAYQEIKQALLTAPALGLPDLTKPFELFVDEKQGYAKGVLTQKLGPWRRPVA YLSKKLDPVAAGWPPCLRMVAAIAVLRKDAGKLTMGQPLVILAPHAVEALVKQPPDREWLSNARMTHYQAMLLDTDRVQFGPVVALNPATLLPLPEEG APHDCLEILAETHGTRPDLTDQPIPDADHTWYTDGSSFLQEGQRKAGAAVTTETEVIWARALPAGTSAQRAELIALTQALKMAEGKRLNVYTDSRYAF ATAHIHGEIYRRRGWLTSEGREIKNKSEILALLKALFPKRLSIIHCLGHQKGDSAEARGNRLADQAAREAAIKTPPDTSTLL |
| MLVBM_Q7SVK7 | 8,056 | TLGIEDEYRLHETSTEPDVSLGSTWLSDFPQAWAETGMGLAVRQAPLIIPLKATSTPVSIQQYPMSHEARLGIKPHIQRLLDQGILVPCQSPWNTPLLP VKKPGTNDYRPVQDLREVNKRVEDIHPTVPNLLSGLPPSHQWYTVLDLKDAFFCLRLHPTSQPLFAFEWRDPGMGISGQLTWTRLPQGFKNSPT LFDEALHRDLADFRIQHPDLILLQYVDDILLAATSELDCQQGTRALLQTLGDLGYRASAKKAQICQKQVKYLGYLLREGQRMLTEARKETVMGQPVPKT PRQLREFLGTAGFCRLWIPGFAEMAAPLYPLIKTGTLFSWGPDQQKAYQEIKQALLTAPALGLPDLTKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT AHIHGEIYRRRGLLTSEGREIKNKSEILALLKALFLPKRLSIIHCLGHQKGDSAEARGNRLADQAAREAAIKTPPDTSTLL |
| MLVBM_Q7SVK7 | 8,057 | TLGIEDEYRLHETSTEPDVSLGSTWLSDFPQAWAETGMGLAVRQAPLIIPLKATSTPVSIQQYPMSHEARLGIKPHIQRLLDQGILVPCQSPWNTPLLP VKKPGTNDYRPVQDLREVNKRVEDIHPTVPNLLSGLPPSHQWYTVLDLKDAFFCLRLHPTSQPLFAFEWRDPGMGISGQLTWTRLPQGFKNSPT LFDEALHRDLADFRIQHPDLILLQYVDDILLAATSELDCQQGTRALLQTLGDLGYRASAKKAQICQKQVKYLGYLLREGQRMLTEARKETVMGQPVPKT PRQLREFLGTAGFCRLWIPGFAEMAAPLYPLIKTGTLFSWGPDQQKAYQEIKQALLTAPALGLPDLTKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT AHIHGEIYRRRGLLTSEGREIKNKSEILALLKALFLPKRLSIIHCLGHQKGDSAEARGNRLADQAAREAAIKTPPDTSTLL |
| MLVBM_Q7SVK7_3mut | 8,058 | TLGIEDEYRLHETSTEPDVSLGSTWLSDFPQAWAETGMGLAVRQAPLIIPLKATSTPVSIQQYPMSHEARLGIKPHIQRLLDQGILVPCQSPWNTPLLP VKKPGTNDYRPVQDLREVNKRVEDIHPTVPNLLSGLPPSHQWYTVLDLKDAFFCLRLHPTSQPLFAFEWRDPGMGISGQLTWTRLPQGFKNSPT LFNEALHRDLADFRIQHPDLILLQYVDDILLAATSELDCQQGTRALLQTLGDLGYRASAKKAQICQKQVKYLGYLLREGQRMLTEARKETVMGQPVPKT PRQLREFLGTAGFCRLWIPGFAEMAAPLYPLIKTGTLFSWGPDQQKAYQEIKQALLTAPALGLPDLTKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGA PHDCLEILAETHGTRPDLTDQPIPDADHTWYTDGSSFLQEGQRKAGAAVTTETEVIWAGALPAGTSAQRAELIALTQALKMAEGKRLNVYTDSRYAFA TAHIHGEIYRRRGWLTSEGREIKNKSEILALLKALFLPKRLSIIHCLGHQKGDSAEARGNRLADQAAREAAIKTPPDTSTLL |
| MLVBM_Q7SVK7_3mutA | 8,059 | TLGIEDEYRLHETSTEPDVSLGSTWLSDFPQAWAETGMGLAVRQAPLIIPLKATSTPVSIQQYPMSHEARLGIKPHIQRLLDQGILVPCQSPWNTPLLP VKKPGTNDYRPVQDLREVNKRVEDIHPTVPNLLSGLPPSHQWYTVLDLKDAFFCLRLHPTSQPLFAFEWRDPGMGISGQLTWTRLPQGFKNSPT LFNEALHRDLADFRIQHPDLILLQYVDDILLAATSELDCQQGTRALLQTLGDLGYRASAKKAQICQKQVKYLGYLLREGQRMLTEARKETVMGQPVPKT PRQLREFLGTAGFCRLWIPGFAEMAAPLYPLIKTGTLFSWGPDQQKAYQEIKQALLTAPALGLPDLTKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGA PHDCLEILAETHGTRPDLTDQPIPDADHTWYTDGSSFLQEGQRKAGAAVTTETEVIWAGALPAGTSAQRAELIALTQALKMAEGKRLNVYTDSRYAFA TAHIHGEIYRRRGWLTSEGREIKNKSEILALLKALFLPKRLSIIHCLGHQKGDSAEARGNRLADQAAREAAIKTPPDTSTLL |
| MLVBM_Q7SVK7_3mutA_WS | 8,060 | LGIEDEYRLHETSTEPDVSLGSTWLSDFPQAWAETGMGLAVRQAPLIIPLKATSTPVSIQQYPMSHEARLGIKPHIQRLLDQGILVPCQSPWNTPLLPV KKPGTNDYRPVQDLREVNKRVEDIHPTVPNLLSGLPPSHQWYTVLDLKDAFFCLRLHPTSQPLFAFEWRDPGMGISGQLTWTRLPQGFKNSPTL FNEALHRDLADFRIQHPDLILLQYVDDILLAATSELDCQQGTRALLQTLGDLGYRASAKKAQICQKQVKYLGYLLREGQRMLTEARKETVMGQPVPKTP RQLREFLGKAGFCRLFIPGFAEMAAPLYPLTKPGTLFSWGPDQQKAYQEIKQALLTAPALGLPDLTKPFELFVDEKQGYAKGVLTQKLGPWRRPVAYL SKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAP HDCLEILAETHGTRPDLTDQPIPDADHTWYTDGSSFLQEGQRKAGAAVTTETEVIWAGALPAGTSAQRAELIALTQALKMAEGKRLNVYTDSRYAFAT AHIHGEIYRRRGWLTSEGREIKNKSEILALLKALFLPKRLSIIHCLGHQKGDSAEARGNRLADQAAREAAIKTPPDTSTLLI |

TABLE 6-continued

Exemplary reverse transcriptase domains from retroviruses

| RT Name | SEQ ID NO: | RT amino acid sequence |
|---|---|---|
| MLVBM_Q7SVK7_3mutA_ws | 8,061 | LGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPV KKPGTNDYRPVQDLREVNKRVEDIHPTVPNPYNLLSGLPPSHQWYTLVLDLKDAFFCLRLHPTSQPLFAFEWRDPMGISGQLTWTRLPQGFKNSPTL FNEALHRDLADFRIQHPDLILLQYVDDILLAATSELDCQQGTRALLQTLGDILGYRASAKKAQICQKQVKYLGYLLREGQRWLTEARKETVMGQPVPKTP RQLREFLGKAGFCRLFIPGFAEMAAPLYPLTKPGTLFSWGPDQQKAYQEIKQALLTAPALGLPDLTKPFELFVDEKQYAKGVLTQKLGPWRRPVAYL SKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAG HDCLEILAETHGTRPDLTDQPIPDADHTWYTDGSSFLQEGGRKAGAAVTTETEVIWAGALPAGTSAQRAELIALTQALKMAEGKRLNVYTDSRYAFAT AHIHGEIYRRGWLTSEGREIKNKSEILALLKALFLPKRLSIIHCLGHQKGDSAEARGNRLADQAAREEAAIKTPPDTSTLLI |
| MLVCB_P08361 | 8,062 | TLNIEDEYRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTLVLDLKDAFFCLRLHPTSQPLFAFEWRDPEMGISGQLTWTRLPQGFKNSPT LFDEALHRDLAGFRIQHPDLILLQYVDDLLLAATSELDCQQGTRALLQTLGDLGYRASAKKAQICQKQVKYLGYLLKEGQRWLTEARKETVMGQPIPKT PRQLREFLGTAGFCRLFIPGFAEMAAPLYPLITKPGTLFNWGPDQQKAFQEIKQALLTAPALGLPDLTKPFELFVDEKQGYAKGVLTQKLGPWRRPVAY LSKKLDPVAAGWPPCLRMVAAIAVLTKDAGKLTMGQPLVILAPHAVEALVTKDRVQFGPVVALNPATLLPLPEEGLQ HDCLDILAEAHGTRSDLMDQPLPDADHTWYTDGSSFLQEGQRKAGAAVTTETEVIWARALPAGTSAQRAELIALTQALKMAEGKKLNVYTDSRYAFAT AHIHGEIYRRGLLTSEGKEIKNKDEILALLKALFLPKRLSIIHCPGHQKGNSAEARGNRMADQAAREVATRETPETSTLL |
| MLVCB_P08361_3mut | 8,063 | TLNIEDEYRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTLVLDLKDAFFCLRLHPTSQPLFAFEWRDPEMGISGQLTWTRLPQGFKNSPT LFNEALHRDLAGFRIQHPDLILLQYVDDLLLAATSELDCQQGTRALLQTLGDLGYRASAKKAQICQKQVKYLGYLLKEGQRWLTEARKETVMGQPIPKT PRQLREFLGKAGFCRLFIPGFAEMAAPLYPLITKPGTLFNWGPDQQKAFQEIKQALLTAPALGLPDLTKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGL QHDCLDILAEAHGTRSDLMDQPLPDADHTWYTDGSSFLQEGQRKAGAAVTTETEVIWARALPAGTSAQRAELIALTQALKMAEGKKLNVYTDSRYAF ATAHIHGEIYRRGWLTSEGKEIKNKDEILALLKALFLPKRLSIIHCPGHQKGNSAEARGNRMADQAAREVATRETPETSTLL |
| MLVCB_P08361_3mutA | 8,064 | TLNIEDEYRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTLVLDLKDAFFCLRLHPTSQPLFAFEWKDPEMGISGQLTWTRLPQGFKNSPT LFNEALHRDLAGFRIQHPDLILLQYVDDLLLAATSELDCQQGTRALLQTLGDLGYRASAKKAQICQKQVKYLGYLLKEGQRWLTEARKETVMGQPIPKT PRQLREFLGKAGFCRLFIPGFAEMAAPLYPLITKPGTLFNWGPDQQKAFQEIKQALLTAPALGLPDLTKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ HDCLDILAEAHGTRPDLTDQPLPDADHTWYTDGSSFLQEGQRRAGAAVTTETEVIWARALPAGTSAQRAELIALTQALKMAAGGKKLNVYTDSRYAFAT AHIHGEIYRRGWLTSEGKEIKNKDEILALLKALFLPKRLSIIHCPGHQKGNHAEARGNRMADQAAREVATRETPETSTLL |
| MLVF5_P26810 | 8,065 | TLNIEDEYRLHETSKGPDVPLGSTWLSDFPQAWAETGMGLAFRQAPLIISLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTLVLDLKDAFFCLRLHPTSQSLFAFEWKDPEMGISGQLTWTRLPQGFKNSPT LFDEALHRDLAGFRIQHPDLILLQYVDDLLLAATSELDCQQGTRALLQTLGDLGYRASAKKAQICQKQVKYLGYLLKEGQRWLTEARKETVMGQPTPKT PRQLREFLGTAGLCRLWIPGFAEMAAPLYPLITKDVGKLTMGQPLVILAPHAVEALVKQPPDQQKAYQEIKQALLTAPALGLPDLTKPFELFVDEKQGYAKGVLTQKLGPWRRPVAY LSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQ HDCLDILAEAHGTRPDLTDQPLPDADHTWYTDGSSFLQEGQRRAGAAVTTETEVIWAKALPAGTSAQRAELIALTQALKMAAGGKKLNVYTDSRYAFAT AHIHGEIYRRGLLTSEGKEIKNKDEILALLKALFLPKRLSIIHCPGHQKGNHAEARGNRMADQAAREVATRETPETSTLL |
| MLVF5_P26810_3mut | 8,066 | TLNIEDEYRLHETSKGPDVPLGSTWLSDFPQAWAETGMGLAFRQAPLIISLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTLVLDLKDAFFCLRLHPTSQSLFAFEWKDPEMGISGQLTWTRLPQGFKNSPT LFNEALHRDLAGFRIQHPDLILLQYVDDLLLAATSELDCQQGTRALLQTLGDLGYRASAKKAQICQKQVKYLGYLLKEGQRWLTEARKETVMGQPTPKT PRQLREFLGTAGLCRLWIPGFAEMAAPLYPLITKDVGKLTMGQPLVILAPHAVEALVKQPPDQQKAYQEIKQALLTAPALGLPDLTKPFELFVDEKQGYAKGVLTQKLGPWRRPVAY LSKKLDPVAAGWPPCLRMVAAIAVLTKDVGKLTMGQPLVILAPHAVEALVKQPPDRWLSNARMTHYQALLLDTDRVQFGPIVALNPATLLPLPEEGLQ HDCLDILAEAHGTRPDLTDQPLPDADHTWYTDGSSFLQEGQRRAGAAVTTETEVIWAKALPAGTSAQRAELIALTQALKMAAGGKKLNVYTDSRYAFAT AHIHGEIYRRGWLTSEGKEIKNKDEILALLKALFLPKRLSIIHCPGHQKGNHAEARGNRMADQAAREVATRETPETSTLL |

TABLE 6-continued

Exemplary reverse transcriptase domains from retroviruses

| RT Name | SEQ ID NO: | RT amino acid sequence |
|---|---|---|
| MLVF5_P26810_3mutA | 8,067 | TLNIEDEYRLHETSKGPDVPLGSTWLSDFPQAWAETGMGLAPRQAPLIISLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQSLFAFEWKDPEMGISGQLTWTRLPQGFKNSPT LFNEALHRDLADFRIQHPDLILLQYVDDLLLAATSELDCQQGTRALLQTLGDLGYRASAKKAQICQKQVKYLGYLLKEGQRWLTEARKETVMGQPTPKT PRQLREFLGKAGLCRLFIPGFAEMAAPLYPLTKPGTLFKWGPDQQKAYQEIKQALLTAPALGLPDLTKPFELFVDEKQGYAKGVLTQKLGPWRRPVAY LSKKLDPVAAGWPPCLRMWAAIAVLTKDVGKLTMGQPLVILAPHAVEALVKDPDRWLSNARMTHYQALLLDTDRVQFGPIVALNPATLLPLPEEGLQ HDCLDILAEAHGTRPDLTDQPLPDADHTWYTDGSSFLQEGQRAGAAVVTETEVIWAKALPAGTSAQRAELIALTQALKMAAGKKLNVYTDSRYAFAT AHIHGEIYRRGWLTSEGKEIKNKDEILALLKALFLPKRLSIIHCPGHQKGNHAEARGNRMADQAAREVATRETPETSTLL |
| MLVFF_P26809_3mut | 8,068 | TLNIEDEYRLHETSKGPDVPLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPT LFNEALHRDLADFRIQHPDLILLQYVDDLLLAATSELDCQQGTRALLQTLGDLGYRASAKKAQICQKQVKYLGYLLKEGQRWLTEARKETVMGQPTPKT PRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVA YLSKKLDPVAAGWPPCLRMWAAIAVLTKDAGKLTMGQPLVILAPHAVEALVKQPPDRWLSNARMTHYQALLLDTDRVQFGPIVALNPATLLPLPEEGLQ HDCLDILAEAHGTRPDLTDQPLPDADHTWYTDGSSFLQEGQRKAGAAVVTETEVVWAKALPAGTSAQRAELIALTQALKMAEGKKLNVYTDSRYAFA TAHIHGEIYRRGWLTSEGKEIKNKDEILALLKALFLPKRLSIIHCPGHQKGNRAEARGNRMADQAAREVATRETPETSTLL |
| MLVFF_P26809_3mutA | 8,069 | TLNIEDEYRLHETSKGPDVPLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPT LFNEALHRDLADFRIQHPDLILLQYVDDLLLAATSELDCQQGTRALLQTLGDLGYRASAKKAQICQKQVKYLGYLLKEGQRWLTEARKETVMGQPTPKT PRQLREFLGTAGFCRLWIPGFAEMAAPLYPLTKPGTLFEWGPDQQKAYQEIKQALLTAPALGLPDLTKPFELFVDEKQGYAKGVLTQKLGPWRRPVA YLSKKLDPVAAGWPPCLRMWAAIAVLTKDAGKLTMGQPLVILAPHAVEALVKQPPDRWLSNARMTHYQALLLDTDRVQFGPIVALNPATLLPLPEEGLQ HDCLDILAEAHGTRPDLTDQPLPDADHTWYTDGSSFLQEGQRKAGAAVVTETEVIWAKALPAGTSAQRAELIALTQALKMAEGKKLNVYTDSRYAFA TAHIHGEIYRRGWLTSEGKEIKNKDEILALLKALFLPKRLSIIHCPGHQKGNRAEARGNRMADQAAREVATRETPETSTLL |
| MLVMS_P03355 | 8,070 | TLNIEDEHRLHETSKEPDVSLGSTWLSDFPPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFDEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA YLSKKLDPVAAGWPPCLRMWAAIAVLTKDAGKLTMGQPLVILAPHAVEALVKQPPDRWLSNARMTHYQALLLDTDRVQFGPVVALNPATLLPLPEEGL QHNCLDILAEAHGTRPDLTDGSSLLQEGQRKAGAAVVTETEVIWAKALPAGTSAQRAELIALTQALKMAEGKKLNVYTDSRYAFAT TAHIHGEIYRRGWLTSEGKEIKNKDEILALLKALFLPKRLSIIHCPGHQKGHSAEARGNRMADQAARKAAITETPDTSTLL |
| MLVMS reference | 8,137 | TLNIEDEHRLHETSKEPDVSLGSTWLSDFPPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFDEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA YLSKKLDPVAAGWPPCLRMWAAIAVLTKDAGKLTMGQPLVILAPHAVEALVKQPPDRWLSNARMTHYQALLLDTDRVQFGPVVALNPATLLPLPEEGL QHNCLDILAEAHGTRPDLTDGSSLLQEGQRKAGAAVVTETEVIWAKALPAGTSAQRAELIALTQALKMAEGKKLNVYTDSRYAFAT TAHIHGEIYRRGWLTSEGKEIKNKDEILALLKALFLPKRLSIIHCPGHQKGHSAEARGNRMADQAARKAAITETPDTSTLLIENSSP |
| MLVMS_P03355 | 8,071 | TLNIEDEHRLHETSKEPDVSLGSTWLSDFPPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFDEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA YLSKKLDPVAAGWPPCLRMWAAIAVLTKDAGKLTMGQPLVILAPHAVEALVKQPPDRWLSNARMTHYQALLLDTDRVQFGPVVALNPATLLPLPEEGL QHNCLDILAEAHGTRPDLTDGSSLLQEGQRKAGAAVVTETEVIWAKALPAGTSAQRAELIALTQALKMAEGKKLNVYTDSRYAFAT TAHIHGEIYRRGWLTSEGKEIKNKDEILALLKALFLPKRLSIIHCPGHQKGHSAEARGNRMADQAARKAAITETPDTSTLL |

TABLE 6-continued

Exemplary reverse transcriptase domains from retroviruses

| RT Name | SEQ ID NO: | RT amino acid sequence |
|---|---|---|
| MLVMS_P03355_3mut | 8,072 | TLNIEDEHRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGTAGFCRLWIPGFAEMAAPLYPLITKPGTLFNWGPDQQKAYQEIKQALLTAPALGLPDLITKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGL QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA TAHIHGEIYRRRGWLTSEGKEIKNKDEILALLKALFLPKRLSIIHCPGHQKGHSAEARGNRMADQAARKAAITETPDTSTLL |
| MLVMS_P03355_3mut | 8,073 | TLNIEDEHRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGTAGFCRLWIPGFAEMAAPLYPLITKPGTLFNWGPDQQKAYQEIKQALLTAPALGLPDLITKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGL QHNCLDILAEAHGTRPDLTDQPLPDADHTWYTDGSSLLQEGQRKAGAAVTTETEVIWAKALPAGTSAQRAELIALTQALKMAEGKKLNVYTDSRYAFA TAHIHGEIYRRRGWLTSEGKEIKNKDEILALLKALFLPKRLSIIHCPGHQKGHSAEARGNRMADQAARKAAITETPDTSTLL |
| MLVMS_P03355_3mutA_WS | 8,074 | TLNIEDEHRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGKAGFCRLFIPGFAEMAAPLYPLITKPGTLFNWGPDQQKAYQEIKQALLTAPALGLPDLITKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT AHIHGEIYRRRGWLTSEGKEIKNKDEILALLKALFLPKRLSIIHCPGHQKGHSAEARGNRMADQAARKAAITETPDTSTLL |
| MLVMS_P03355_3mutA_WS | 8,075 | TLNIEDEHRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGKAGFCRLFIPGFAEMAAPLYPLITKPGTLFNWGPDQQKAYQEIKQALLTAPALGLPDLITKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT AHIHGEIYRRRGWLTSEGKEIKNKDEILALLKALFLPKRLSIIHCPGHQKGHSAEARGNRMADQAARKAAITETPDTSTLL |
| MLVMS_P03355_PLV919 | 8,076 | TLNIEDEHRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGKAGFCRLFIPGFAEMAAPLYPLITKPGTLFNWGPDQQKAYQEIKQALLTAPALGLPDLITKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT AHIHGEIYRRRGWLTSEGKEIKNKDEILALLKALFLPKRLSIIHCPGHQKGHSAEARGNRMADQAARKAAITETPDTSTLLIENSSPSGGSKKRTADGSEF E |
| MLVMS_P03355_PLV919 | 8,077 | TLNIEDEYRLHETSKEPDVSLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSELDCQQGTRALLQTLGNLGYRASAKKAQICQKQVKYLGYLLKEGQRWLTEARKETVMGQPTPKT PRQLREFLGKAGFCRLFIPGFAEMAAPLYPLITKPGTLFNWGPDQQKAYQEIKQALLTAPALGLPDLITKPFELFVDEKQGYAKGVLTQKLGPWRRPVAY LSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQ HNCLDILAEAHGTRPDLTDQPLPDADHTWYTDGSSLLQEGQRKAGAAVTTETEVIWAKALPAGTSAQRAELIALTQALKMAEGKKLNVYTDSRYAFAT |

TABLE 6-continued

Exemplary reverse transcriptase domains from retroviruses

| RT Name | SEQ ID NO: | RT amino acid sequence |
|---|---|---|
| | | AHIHGEIYRRGWLTSEGKEIKNKDEILALLKALFLPKRLSIIHCPGHQKGHSAEARGNRMADQAARKAAITETPDTSTLLIENSSPSGGSKRTADGSEFE |
| MLVRD_P11227 | 8,078 | TLNIEDEYRLHEISTEPDVSPGSTWLSDFPQAWAETGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFDEALHRGLADFRIQHPDLILLQYVDDLLLAATSELDCQQGTRALLKTLGNLGYRASAKKAQICQKQVKYLGYLLREGQRWLTEARKETVMGQPTPKTPRQLREFLGTAGFCRLWIPRFAEMAAPLYPLTKTGTLFNWGPDQQKAYHEIKQALLITAPALGLPDLIKPFELFVDEKQGYAKGVLTQKLGPWRRPVAYLSKKLDPVAAGWPPCLRWVAAIAVLTKDAGKLTMGQPLVILAPHAVERALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRGLLTSEGREIKNKSEILALLKALFLPKRLSIIHCLGHQKGDSAEARGNRLADQAAREAAIKTPDTSTLL |
| MLVRD_P11227_3mut | 8,079 | TLNIEDEYRLHEISTEPDVSPGSTWLSDFPQAWAETGMGLAVRQAPLIIPLKATSTPVSIKQYPMSQEAKLGIKPHIQRLLDQGILVPCQSPWNTPLLPVKKPGTNDYRPVQGLREVNKRVEDIHPTVPNPYNLLSGLPTSHRWYTVLDLKDAFFCLRLHPTSQPLFASEWRDPGMGISGQLTWTRLPQGFKNSPTLFNEALHRGLADFRIQHPDLILLQYVDDLLLAATSELDCQGVKTLGYRASAKKAQICQKQVKYLGYLLREGQRWLTEARKETVMGQPTPKTPRQLREFLGTAGFCRLWIPRFAEMAAPLYPLTKPGTLFNWGPDQQKAYHEIKQALLITAPALGLPDLIKPFELFVDEKQGYAKGVLTQKLGPWRRPVAYLSKKLDPVAAGWPPCLRWVAAIAVLTKDAGKLTMGQPLVILAPHAVERALVKQPPDRWLSNARMTHYQAMLLDTDRVQFGPVVALNPATLLPLPEEGAPHDCLEILAETHGTEPDLTDQPIPDADHTWYTDGSSFLQEGQRKAGAAVTTETEVIWARALPAGTSAQRAELIALTQALKMAEGKRLNVYTDSRYAFATAHIHGEIYKRGLLTSEGREIKNKSEILALLKALFLPKRLSIIHCLGHQKGDSAEARGNRLADQAAREAAIKTPDTSTLL |
| MMTVB_P03365 | 8,080 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQMPLKQEKLQALQQLVTEQLQLGHLEESNSPWNTPVFVIKKKSGKWRLLQDLRAVNATMHDMGALQPGLPSPVAVPKGWEIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLIRILT |
| MMTVB_P03365_2mut | 8,081 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQMPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLIRILT |
| MMTVB_P03365_2mut_ws | 8,082 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQMPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLIRILT |
| MMTVB_P03365_2mut_ws | 8,083 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQMPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVRLDLSQPWSLCILKTEYTPTACLWQDGVVEWIHLPHISPKVITPYDIFCTQLIIKGRHRSKELFSKDP |

TABLE 6-continued

Exemplary reverse transcriptase domains from retroviruses

| RT Name | SEQ ID NO: | RT amino acid sequence |
|---|---|---|
| MMTVB_P03365_2mut_ws | 8,084 | DYIVVPFTKVQFDLLLQEKEDWPISLLGFLGEVHFHFLPKDPLLTFTLQTAIIFPHMSTTPLEKGIVIFTDGSANGRSVTYIQGREPIIKENTQNTAQQAEIV AVITAFEEVSQPFNLYTDSKYVTGLFPEIETATLSPRTKIYTELKHLQRLIHKRQEKFYIGHIRGHTGLPGPLAQGNAYADSLTRILTA |
| MMTV_P03B_365_2mutB | 8,085 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV NATMHDMGALQPGLPSPVAPPKGWEIIIDLQDCFFNIKLHPEDCKRFAFSPVAPKGWEIIIDLQDCFFNIKLHPEDCKRFAFSPVPSNFKRPYQRFQWKVLPQGMKNSPTLCQKFVDKAILTVRDKYQDS YIVHYMDDILLAHPSRSIVDEILTSMIQALNKHGLVVSTEKIQYDNLKYLGTHIQGDSVSYQKLQIRTDKLRTLNDFQKLLGNINWIRPFLKLTTGELKPLF EILNPDSNPISTRKLTPEACKALQLMNERLSTARVKRLDLSQPWSLCILKTEYTPTACLWQDGVVEWIHLPHISPKVITPYDIFCTQLIIKGRHRSKELFSK DPPYIVVPFTKVQFDLLLQEKEDWPISLLGFLGEVHFHFLPKDPLLTFTLQTAIIFPHMSTTPLEKGIVIFTDGSANGRSVTYIQGREPIIKENTQNTAQQA EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_P03365_2mutB | 8,086 | WVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMK DIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAV NATMHDMGALQPGLPSPVAPPKGWEIIIDLQDCFFNIKLHPEDCKRFAFSPVPSNFKRPYQRFQWKVLPQGMKNSPTLCQKFVDKAILTVRDKYQDS YIVHYMDDILLAHPSRSIVDEILTSMIQALNKHGLVVSTEKIQYDNLKYLGTHIQGDSVSYQKLQIRTDKLRTLNDFQKLLGNINWIRPFLKLTTGELKPLF EILNPDSNPISTRKLTPEACKALQLMNERLSTARVKRLDLSQPWSLCILKTEYTPTACLWQDGVVEWIHLPHISPKVITPYDIFCTQLIIKGRHRSKELFSK DPPYIVVPFTKVQFDLLLQEKEDWPISLLGFLGEVHFHFLPKDPLLTFTLQTAIIFPHMSTTPLEKGIVIFTDGSANGRSVTYIQGREPIIKENTQNTAQQA EIVAVITAFEEVSQPFNLYTDSKYVTGLFPEIETATLSPRTKIYTELKHLQRLIHKRQEKFYIGHIRGHTGLPGPLAQGNAYADSLTRILT |
| MMTVB_P03365_2mutB | 8,087 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA TMHDMGALQPGLPSPPAVPKGWEIIIDLQDCFFNIKLHPEDCKRFAFSPVPSNFKRPYQRFQWKVLPQGMKNSPTLCQKFVDKAILTVRDKYQDSYIV HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL NPDSNPISTRKLTPEACKALQLMNERLSTARVKRLDLSQPWSLCILKTEYTPTACLWQDGVVEWIHLPHISPKVITPYDIFCTQLIIKGRHRSKELFSKDP DYIVVPFTKVQFDLLLQEKEDWPISLLGFLGEVHFHFLPKDPLLTFTLQTAIIFPHMSTTPLEKGIVIFTDGSANGRSVTYIQGREPIIKENTQNTAQQAEIV AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_P03365_2mutB | 8,088 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA TMHDMGALQPGLPSPPAVPKGWEIIIDLQDCFFNIKLHPEDCKRFAFSPVPSNFKRPYQRFQWKVLPQGMKNSPTLCQKFVDKAILTVRDKYQDSYIV HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL NPDSNPISTRKLTPEACKALQLMNERLSTARVKRLDLSQPWSLCILKTEYTPTACLWQDGVVEWIHLPHISPKVITPYDIFCTQLIIKGRHRSKELFSKDP DYIVVPFTKVQFDLLLQEKEDWPISLLGFLGEVHFHFLPKDPLLTFTLQTAIIFPHMSTTPLEKGIVIFTDGSANGRSVTYIQGREPIIKENTQNTAQQAEIV AVITAFEEVSQPFNLYTDSKYVTGLFPEIETATLSPRTKIYTELKHLQRLIHKRQEKFYIGHIRGHTGLPGPLAQGNAYADSLTRILTA |
| MMTVB_P03365_ws | 8,089 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNA TMHDMGALQPGLPSPPAVPKGWEIIIDLQDCFFNIKLHPEDCKRFAFSPVPSNFKRPYQRFQWKVLPQGMKNSPTLCQKFVDKAILTVRDKYQDSYIV HYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEIL NGDSNPISTRKLTPEACKALQLMNERLSTARVKRLDLSQPWSLCILKTEYTPTACLWQDGVVEWIHLPHISPKVITPYDIFCTQLIIKGRHRSKELFSKDP |

TABLE 6-continued

Exemplary reverse transcriptase domains from retroviruses

| RT Name | SEQ ID NO: | RT amino acid sequence |
|---|---|---|
| MMTVB_P03365_ws | 8,090 | DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV AVITAFEEVSQPFNLYTDSKYVTGLFPEIETATLSPRTKIYTELKHLQRLIHKRQEKFYIGHRHTGLPGPLAQGNAYADSLTRILTA |
| MMTVB_P03365_Pro | 8,091 | VQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDI KVRLMTDSPDDSQDLMIGAIESNLFADQISWKSDQPVWLNQMPLKQEKLQALQQLVTEQLQLGHLEESNSPWNTPVFVIKKKSGKWRLLQDLRAVNA TMHDMGALQPGLPSPVAPVKGWEIIIDLQDCFNIKLHPEDCKRFAFSVPSPNFKRPYQRFQWKVLPQGMKNSPTLCQKFVDKAILTVRDKYQDSYIV HYMDDILLAHPSRSIVDEILTSMIQALNKHGLVVSTEKIQKYDNLKYLGTHIQGDSVSYQKLQIRTDKLRTLNDFQKLLGNINWIRPPLKLTTGELKPLFEIL NGDSNPISTRKLTPEACKALQLMNERLSTARVKRLDLSQPWSLCILKTEYTPTACLWQDGVVEWIHLPHISPKVITPYDIFCTQLIIKGRHRSKELFSKDP DYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIV AVITAFEEVSQPFNLYTDSKYVTGLFPEIETATLSPRTKIYTELKHLQRLIHKRQEKFYIGHRHTGLPGPLAQGNAYADSLTRILTA |
| MMTVB_P03365_Pro | 8,092 | GRDIMKDIKVRLMTDSPDDSQDLMIGAIESNLFADQISWKSDQPVWLNQWPLKQEKLQALQLVTEQLQLGHLEESNPWNTPVFVIKKKSGKWRLL QDLRAVNATMHDMGALQPGLPSPVAVPKGWEIIIDLQDCFFNIKLHPEDCKRFAFSVPSPNFKRPYQRFQWKVLPQGMKNSPTLCQKFVDKAILTVR DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT GELKPLFEILNGDSNPISTRKLTPEACKALQLMNERLSTARVKRLDLSQPWSLCILKTEYTPTACLWQDGVVEWIHLPHISPKVITPYDIFCTQLIIQGREPI SKELFSKDPDYIVVPYTKVQFDLLLQEKEDWPISLLGFLGEVHFHLPKDPLLTFTLQTAIIFPHMSTTPLEKGIVIFTDGSANGRSVTYIQGREPIIKENTQ NTAQQAEIVAVITAFEEVSQPFNLYTDSKYVTGLFPEIETATLSPRTKIYGIHRGHTGLPGPLAQGNAYADSLTRILT |
| MMTVB_P03365_Pro | 8,093 | GRDIMKDIKVRLMTDSPDDSQDLMIGAIESNLFADQISWKSDQPVWLNQWPLKQEKLQALQLVTEQLQLGHLEESNPWNTPVFVIKKKSGKWRLL QDLRAVNATMHDMGALQPGLPSPVAVPKGWEIIIDLQDCFFNIKLHPEDCKRFAFSVPSPNFKRPYQRFQWKVLPQGMKNSPTLCQKFVDKAILTVR DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT GELKPLFEILNPDSNPISTRKLTPEACKALQMNERLSTARVKRLDLSQPWSLCILKTEYTPTACLWQDGVVEWIHLPHISPKVITPYDIFCTQLIIKGRHR SKELFSKDPDYIVVPYTKVQFDLLLQEKEDWPISLLGFLGEVHFHLPKDPLLTFTLQTAIIFPHMSTTPLEKGIVIFTDGSANGRSVTYIQGREPIIKENTQ NTAQQAEIVAVITAFEEVSQPFNLYTDSKYVTGLFPEIETATLSPRTKIYGIHRGHTGLPGPLAQGNAYADSLTRILT |
| MMTVB_P03365_Pro_2mut | 8,094 | GRDIMKDIKVRLMTDSPDDSQDLMIGAIESNLFADQISWKSDQPVWLNQWPLKQEKLQALQLVTEQLQLGHLEESNPWNTPVFVIKKKSGKWRLL QDLRAVNATMHDMGALQPGLPSPVAVPKGWEIIIDLQDCFFNIKLHPEDCKRFAFSVPSPNFKRPYQRFQWKVLPQGMKNSPTLCQKFVDKAILTVR DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT GELKPLFEILNGDSNPISTRKLTPEACKALQLMNERLSTARVKRLDLSQPWSLCILKTEYTPTACLWQDGVVEWIHLPHISPKVITPYDIFCTQLIIKGRHR SKELFSKDPDYIVVPYTKVQFDLLLQEKEDWPISLLGFLGEVHFHLPKDPLLTFTLQTAIIFPHMSTTPLEKGIVIFTDGSANGRSVTYIQGREPIIKENTQ NTAQQAEIVAVITAFEEVSQPFNLYTDSKYVTGLFPEIETATLSPRTKIYGIHRGHTGLPGPLAQGNAYADSLTRILT |
| MMTVB_P03365_Pro_2mutB | 8,095 | GRDIMKDIKVRLMTDSPDDSQDLMIGAIESNLFADQISWKSDQPVWLNQWPLKQEKLQALQLVTEQLQLGHLEESNPWNTPVFVIKKKSGKWRLL QDLRAVNATMHDMGALQPGLPSPVAPPKGWEIIIDLQDCFFNIKLHPEDCKRFAFSVPSPNFKRPYQRFQWKVLPQGMKNSPTLCQKFVDKAILTVR DKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTT GELKPLFEILNPDSNPISTRKLTPEACKALQLMNERLSTARVKRLDLSQPWSLCILKTEYTPTACLWQDGVVEWIHLPHISPKVITPYDIFCTQLIIKGRHR SKELFSKDPDYIVVPYTKVQFDLLLQEKEDWPISLLGFLGEVHFHLPKDPLLTFTLQTAIIFPHMSTTPLEKGIVIFTDGSANGRSVTYIQGREPIIKENTQ NTAQQAEIVAVITAFEEVSQPFNLYTDSKYVTGLFPEIETATLSPRTKIYGIHRGHTGLPGPLAQGNAYADSLTRILT |
| MMTVB_P03365- | 8,096 | GRDIMKDIKVRLMTDSPDDSQDLMIGAIESNLFADQISWKSDQPVWLNQWPLKQEKLQALQLVTEQLQLGHLEESNPWNTPVFVIKKKSGKWRLL QDLRAVNATMHDMGALQPGLPSPVAPPKGWEIIIDLQDCFFNIKLHPEDCKRFAFSVPSPNFKRPYQRFQWKVLPQGMKNSPTLCQKFVDKAILTVR |

TABLE 6-continued

Exemplary reverse transcriptase domains from retroviruses

| RT Name | SEQ ID NO: | RT amino acid sequence |
|---|---|---|
| Pro_2mutB | | DKYQDSYIVHYMDDILLAHPSRSIVDEILTSMIQALNKHGLVVSTEKIQKYDNLKYLGTHIQGDSVYQKLQIRTDKLRTLNDFQKLLGNINWIRPLKLTT GELKPLFLEILNPDSNPISTRKLTPEACKALQLMNERLSTARVRLDLSQPWSLCILKEYTPACLMQDGVVEWIHLPHISPKVITPYDIFCTQLIIKGRHR SKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQ NTAQQAEIVAVITAFEEVSQPFNLYTDSKYVTGLFPEIETAILSPRTKIYTELKHLQRLIIHKRQEKPYIGHIRGHTGLPGPLAQGNAYADSLTRILT |
| MPMV_P07572 | 8,097 | LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLP SPVAIPQGVLKIIIDLKDCFFSIPLHPSDQKRAFSLPSTNFKEPMQRFQWKVLPQGMANSPTLCQKVATAIHKVRHAWKQMYIIHYMDDILIAGKDGQ QVLQCFDQLKQELTAAGLHIAPEKVQLQDPYTYLGFELNGPKITNQKAVIRKDKLQTINDFQKLLGDINWLRPYLKLTTGDLKPLFDTLKGDSDPNSHR SLSKEALASLEKVETAIAEQFVTHINYSLPLIFLIFNTALTPTGLFWQDNPIMWIHLPASPKKVLLPYDAIADLILLGRDHSKKYFPGIEPSTIIQPYSKSQIDW LMQNTEMMPIACASFVGILDNHYPPNKLIQFCKLHTFVFPQIISKTPLNNALLIVFTDGSSTGMAAYTLTDTTIKFQTNLNSAQLVELQALIAVLSAFPNQPL NIYTDSAYLAHSIPLLETVAQIKHISETAKLFLQCQQLIYNRSIPFYIGHVRAHSGLPGPIAQGNQRADLATKIVASNINT |
| MPMV_P07572_2mutB | 8,098 | LTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLP SPVAPPQGVLKIIIDLKDCFFSIPLHPSDQKRAFSLPSTNFKEPMQRFQWKVLPQGMANSPTLCQKVATAIHKVRHAWKQMYIIHYMDDILIAGKDGQ QVLQCFDQLKQELTAAGLHIAPEKVQLQDPYTYLGFELNGPKITNQKAVIRKDKLQTINDFQKLLGDINWLRPYLKLTTGDLKPLFDTLKPDSDPNSHRS LSKEALASLEKVETAIAEQFVTHINYSLPLIFLIFNTALTPTGLFWQDNPIMWIHLPASPKKVLLPYDAIADLILLGRDHSKKYFGIEPSTIIQPYSKSQIDWL MQNTEMWPIACASFVGILDNHYPPNKLIQFCKLHTFVFPQIISKTPLNNALLIVFTDGSSTGMAAYTLTDTTIKFQTNLNSAQLVELQALIAVLSAFPNQPL NIYTDSAYLAHSIPLLETVAQIKHISETAKLFLQCQQLIYNRSIPFYIGHVRAHSGLPGPIAQGNQRADLATKIVASNINT |
| PERV_Q4VFZ2 | 8,099 | TLQLDDEYRLYSPLVKPDQNIQFWLEQPPQAWAETAGMGLAKQVPPQVIQLKASATPVSVRQYPLSKEAQEGIRPHVQRLIQQGILVPVQSPWNTPLL PVRRKPGTNDYRPVQDLREVNKRVQDIHPTVPNPYNLLCALPPQRSWYTVLDLKDAFFCLRLHPTSQPLFAFEWRDPGTRTGQLTWTRLPQGFKNS PTIFDEALHRDLANFRIQHPQVTLLQYVDDLLLAGATKQDCLEGTKALLLELSDLGYRASAKKAQICRREVTYLGYSLRDGQRWLTEARKKTVVQIPAPT TAKQVREFLGTAGFCRLWIPGFATLAAPLYPLTKEKGEFSWAPEHQKAFDAIKKALLSAPALALPDVTKPFTLYVDERKGVARGVLTQTLGPMRRPVA YLSKKLDPVASGMPVCLKAIAAVAILVKDADKLTLGQNITVIAPHALENIVRQPPDRWMTNARMTHYQSLLLTERVTFAPPAALNPATLLPEETDEPVTH DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH VHGAIYKQRGLLTSAGREIKNKEEILSLLEALHLPKRLAIIHCPGHQKAKDPISRGNQMADRVAKQAAQGVNLL |
| PERV_Q4VFZ2_3mut | 8,100 | TLQLDDEYRLYSPLVKPDQNIQFWLEQPPQAWAETAGMGLAKQVPPQVIQLKASATPVSVRQYPLSKEAQEGIRPHVQRLIQQGILVPVQSPWNTPLL PVRRKPGTNDYRPVQDLREVNKRVQDIHPTVPNPYNLLCALPPQRSWYTVLDLKDAFFCLRLHPTSQPLFAFEWRDPGTRTGQLTWTRLPQGFKNS PTIFDEALHRDLANFRIQHPQVTLLQYVDDLLLAGATKQDCLEGTKALLLELSDLGYRASAKKAQICRREVTYLGYSLRDGQRWLTEARKKTVVQIPAPT TAKQVREFLGTAGFCRLWIPGFATLAAPLYPLTKPGKGEFSWAPEHQKAFDAIKKALLSAPALALPDVTKPFTLYVDERKGVARGVLTQTLGPMRRPVA YLSKKLDPVASGMPVCLKAIAAVAILVKDADKLTLGQNITVIAPHALENIVRQPPDRWMTNARMTHYQSLLLTERVTFAPPAALNPATLLPEETDEPVTH DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH VHGAIYKQRGLLTSAGREIKNKEEILSLLEALHLPKRLAIIHCPGHQKAKDPISRGNQMADRVAKQAAQGVNLL |
| PERV_Q4VFZ2_3mut | 8,101 | TLQLDDEYRLYSPLVKPDQNIQFWLEQPPQAWAETAGMGLAKQVPPQVIQLKASATPVSVRQYPLSKEAQEGIRPHVQRLIQQGILVPVQSPWNTPLL PVRRKPGTNDYRPVQDLREVNKRVQDIHPTVPNPYNLLCALPPQRSWYTVLDLKDAFFCLRLHPTSQPLFAFEWRDPGTRTGQLTWTRLPQGFKNS PTIFNEALHRDLANFRIQHPQVTLLQYVDDLLLAGATKQDCLEGTKALLLELSDLGYRASAKKAQICRREVTYLGYSLRDGQRWLTEARKKTVVQIPAPT TAKQVREFLGTAGFCRLWIPGFATLAAPLYPLTKPGKGEFSWAPEHQKAFDAIKKALLSAPALALPDVTKPFTLYVDERKGVARGVLTQTLGPMRRPVA YLSKKLDPVASGMPVCLKAIAAVAILVKDADKLTLGQNITVIAPHALENIVRQPPDRWMTNARMTHYQSLLLTERVTFAPPAALNPATLLPEETDEPVTH DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH VHGAIYKQRGLLTSAGREIKNKEEILSLLEALHLPKRLAIIHCPGHQKAKDPISRGNQMADRVAKQAAQGVNLL |
| PERV_Q4VFZ2_3mut | 8,102 | TLQLDDEYRLYSPLVKPDQNIQFWLEQPPQAWAETAGMGLAKQVPPQVIQLKASATPVSVRQYPLSKEAQEGIRPHVQRLIQQGILVPVQSPWNTPLL PVRRKPGTNDYRPVQDLREVNKRVQDIHPTVPNPYNLLCALPPQRSWYTVLDLKDAFFCLRLHPTSQPLFAFEWRDPGTRTGQLTWTRLPQGFKNS PTIFNEALHRDLANFRIQHPQVTLLQYVDDLLLAGATKQDCLEGTKALLLELSDLGYRASAKKAQICRREVTYLGYSLRDGQRWLTEARKKTVVQIPAPT TAKQVREFLGTAGFCRLWIPGFATLAAPLYPLTKPGKGEFSWAPEHQKAFDAIKKALLSAPALALPDVTKPFTLYVDERKGVARGVLTQTLGPMRRPVA YLSKKLDPVASGNPVCLKAIAAVAILVKDADKLTLGQNITVIAPHALENIVRQPPDRWMTNARMTHYQSLLLTERVTFAPPAALNPATLLPEETDEPVTH |

TABLE 6-continued

Exemplary reverse transcriptase domains from retroviruses

| RT Name | SEQ ID NO: | RT amino acid sequence |
|---|---|---|
| | | DCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAH VHGAIYKQRGWLTSAGREIKNKEEILSLLEALHLPKRLAIIHCPGHQKAKDPISRGNQMADRVAKQAAQGVNLL |
| PERV_Q4VFZ2_3mutA_WS | 8,103 | LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVR KPGTNDYRPVQDLREVNKRVQDIHPTVPNPYNLLCALPPQRSWYTVLDLKDAFFCLRLHPTSQPLFAFEWRDPGTGRTGQLIWTRLPQGFKNSPTIF NEALHRDLANFRIQHPQVTLLQVDDLLLAGATKQDCLEGTKALLLELSDLGYRASAKKAQICRREVTYLGYSLRDGQRWLTEARKKTVVQIPAPTTAK QVREFLGKAGFCRLFIPGFATLAAPLYPLTKPKGEFSWAPEHQKAFDAIKKALLSAPALALPDVTKPPTLYVDERKGVARGVLTQTLGPWRRPVAYLSK KLDPVASGWPVCLKAIAAVAIIVKDADKLTLGQNITVIAPHALENIVRQPPDRWMTNARMTHYQSLLLTERVTFAPPAALNPATLLPEETDPVTHDCHQ LIIEETGVRKDLTDIPLTGEVLTWFTDGSSYVVEGKRMAGAAVVDGTRTIWASSLPEGTSAQKAELMALTQALRLAEGKSINIYTDSRYAFATAHVGAI YKQRGWLTSAGREIKNKEEILSLLEALHLPKRLAIIHCPGHQKAKDPISRGNQMADRVAKQAAQGVNLLP |
| PERV_Q4VFZ2_3mutA_WS | 8,104 | LDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVR KPGTNDYRPVQDLREVNKRVQDIHPTVPNPYNLLCALPPQRSWYTVLDLKDAFFCLRLHPTSQPLFAFEWRDPGTGRTGQLIWTRLPQGFKNSPTIF NEALHRDLANFRIQHPQVTLLQVDDLLLAGATKQDCLEGTKALLLELSDLGYRASAKKAQICRREVTYLGYSLRDGQRWLTEARKKTVVQIPAPTTAK QVREFLGKAGFCRLFIPGFATLAAPLYPLTKPKGEFSWAPEHQKAFDAIKKALLSAPALALPDVTKPPTLYVDERKGVARGVLTQTLGPWRRPVAYLSK KLDPVASGWPVCLKAIAAVAIIVKDADKLTLGQNITVIAPHALENIVRQPPDRWMTNARMTHYQSLLLTERVTFAPPAALNPATLLPEETDPVTHDCHQ LIIEETGVRKDLTDIPLTGEVLTWFTDGSSYVVEGKRMAGAAVVDGTRTIWASSLPEGTSAQKAELMALTQALRLAEGKSINIYTDSRYAFATAHVGAI YKQRGWLTSAGREIKNKEEILSLLEALHLPKRLAIIHCPGHQKAKDPISRGNQMADRVAKQAAQGVNLLP |
| SFV1_P23074 | 8,105 | MDPLQLIQPLEAEIKGTKLKAHWNSGATITCVPEAFLEDERPIQTMLIKTIHGEKQQDVYYLTFKVQGRKVEAEVLASPYDYILLNPSDVPWLMKKPLQL TVLVPLHEYQERLLQQTALPKEQKELLQKLFLFKYDALWQHWENQVGHRRIKPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTAD VVDLLKEIPNVQAYVDDIYISHDDPQEHLEQLEKIFSILLNAGYVVSLKKSEIAQREVEFLGPNITKEGRGLIDTFKQKLLNITPPKDLKQLQSILGLLNFAR NFIPNYSELVKPLYTIVANANGKFISWTEDNSNQLQHIISVLNQADNLEERNPETRLIIKVNSSPSAGYIRYYNEGSKRPIMVYNYIFSKAEAKFTQTEKLL TTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIK HPDVNKSHSAGMGIAQVQFIPEYKIVHQWSIPLGDHTAQLAEIAAVEFACKKALKISGPVLIVTDSFVVAESANKELPYWKSNGFLNNKKKPLRHVSKW KSIAECLQLKPDIIIMHEKGHQQPMTTLHTEGNNLADKLATQGSYVH |
| SFV1_P23074_2mut | 8,106 | MDPLQLIQPLEAEIKGTKLKAHWNSGATITCVPEAFLEDERPIQTMLIKTIHGEKQQDVYYLTFKVQGRKVEAEVLASPYDYILLNPSDVPWLMKKPLQL TVLVPLHEYQERLLQQTALPKEQKELLQKLFLFKYDALWQHWENQVGHRRIKPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNAD VVDLLKEIPNVQAYVDDIYISHDDPQEHLEQLEKIFSILLNAGYVVSLKKSEIAQREVEFLGFNITKEGRGLIDTFKQKLLNITPPKDLKQLQSILGLLNFAR NFIPNYSELVKPLYTIVAPANGKFISWTEDNSNQLQHIISVLNQADNLEERNPETRLIIKVNSSPSAGYIRYYNEGSKRPIMVYNYIFSKAEAKFTQTEKLL TMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKH PDVNKSHSAGMGIAQVQFIPEYKIVHQWSIPLGDHTAQLAEIAAVEFACKKALKISGPVLIVTDSFVVAESANKELPYWKSNGFLNNKKKPLRHVSKWK SIAECLQLKPDIIIMHEKGHQQPMTTLHTEGNNLADKLATQGSYVH |
| SFV1_P23074_2mutA | 8,107 | MDPLQLIQPLEAEIKGTKLKAHWNSGATITCVPEAFLEDERPIQTMLIKTIHGEKQQDVYYLTFKVQGRKVEAEVLASPYDYILLNPSDVPWLMKKPLQL TVLVPLHEYQERLLQQTALPKEQKELLQKLFLFKYDALWQHWENQVGHRRIKPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNAD VVDLLKEIPNVQAYVDDIYISHDDPQEHLEQLEKIFSILLNAGYVVSLKKKSEIAQREVEFLGFNITKEGRGLIDTFKQKLLNITPPKDLKQLQSILGKLNFAR NFIPNYSELVKPLYTIVAPANGKFISWTEDNSNQLQHIISVLNQADNLEERNPETRLIIKVNSSPSAGYIRYYNEGSKRPIMVYNYIFSKAEAKFTQTEKLT TMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKH PDVNKSHSAGMGIAQVQFIPEYKIVHQWSIPLGDHTAQLAEIAAVEFACKKALKISGPVLIVTDSFVVAESANKELPYWKSNGFLNNKKKPLRHVSKWK SIAECLQLKPDIIIMHEKGHQQPMTTLHTEGNNLADKLATQGSYVH |
| SFV1_P23074- | 8,108 | VPWLMKKPLQLTVLVPLHEYQERLLQQTALPKEQKELLQKLFLFKYDALMQHWENQVGHRRIKPHNIATGTLAPRPQKQYPINPKAKPSIQIVIDDLLKQ GVLIQQNSTMNTPVYPVPKPDGKWRMVLDYREVNKTIPLIAAQNHSAGILSSIYRGKYKTTLDLTNGFWAHPITPESYWLTAFTWQGKQYCWTRLPQ |

TABLE 6-continued

Exemplary reverse transcriptase domains from retroviruses

| RT Name | SEQ ID NO: | RT amino acid sequence |
|---|---|---|
| Pro | | GFLNSPALFTADVVDLLKEIPNVQAYVDDIYIYISHDDPQEHLEQLEKIFSILLNAGYVVSLKKSEIAQREVEFLGFNITKEGRGLTDTFKQLLNITPPKDLKQ LQSILGLLNFARNFIPNYSELVKPLYTIVANANGKFISWTEDNSNQLQHIISVLNQADNLEERNPETRLIIKVNSSPSAGYIRYNEGSKRPIMYVNYIFSKA EAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFA MVFYTDGSAIKHPDVNKSHSAGMGIAQVQFIPEYKIVHQWSIPLGDHTAQLAEIAAVEFACKKALKISGPVLITDSFYVAESANKELPYWKSNGFLNNK KRPLRHVSKWKSIAECLQLKPDIIIMHEKGHQQPMTLHTEGNNLADKLATQGSYVH |
| SFV1_P23074_Pro_2mut | 8,109 | VPW TABLE 6-continued Exemplary reverse transcriptase domains from retroviruses

| RT Name | SEQ ID NO: | RT amino acid sequence |
|---|---|---|
| SFV3L_P27401_Pro | 8,114 | IPWLMKPQLTTLVPLQEYEERLLKQTMLTGSYKEKLQSLFLKYDALWQHWENQVGHRRIKPHHIATGTVNPRPQKQYPINPKAKASIQTVINDLLKQ GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ GFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDL KQLQSILGLLNFARNFIPNFSELVKPLYNIIATANGKYITWTTDNSQOLQNIISMLNSAENLEERNPEVRLIMKVNTSPSAGYIRFYNEFAKRPIMYLNYVY TKAEVKFTNTEKLLTTIHKGLIKALDLGMGQEILVYSPIVSMFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN NKKKPLKHVSKWKSIADCIQLKPDIIIHEKGHQPTASTFHTEGNNLADKLATQGSYVVN |
| SFV3L_P27401_Pro_2mut | 8,115 | IPWLMKPQLTTLVPLQEYEERLLKQTMLTGSYKEKLQSLFLKYDALWQHWENQVGHRRIKPHHIATGTVNPRPQKQYPINPKAKASIQTVINDLLKQ GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ GFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDL KQLQSILGLLNFARNFIPNFSELVKPLYNIIATAPGKYITWTTDNSQOLQNIISMLNSAENLEERNPEVRLIMKVNTSPSAGYIRFYNEFAKRPIMYLNYVY TKAEVKFTNTEKLLTTIHKGLIKALDLGMGQEILVYSPIVSMTKIQKTPLPERKALPIRWITMWSYLEDPRIQFHYDKTLPELQQVPTVTDDIIAKIKHPSEF SMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN NKKKPLKHVSKWKSIADCIQLKPDIIIHEKGHQPTASTFHTEGNNLADKLATQGSYVVN |
| SFV3L_P27401_Pro_2mutA | 8,116 | IPWLMKPQLTTLVPLQEYEERLLKQTMLTGSYKEKLQSLFLKYDALWQHWENQVGHRRIKPHHIATGTVNPRPQKQYPINPKAKASIQTVINDLLKQ GVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQ GFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDL KQLQSILGKLNFARNFIPNFSELVKPLYNIIATAPGKYITWTTDNSQOLQNIISMLNSAENLEERNPEVRLIMKVNTSPSAGYIRFYNEFAKRPIMYLNYVY TKAEVKFTNTEKLLTTIHKGLIKALDLGMGQEILVYSPIVSMTKIQKTPLPERKALPIRWITMWSYLEDPRIQFHYDKTLPELQQVPTVTDDIIAKIKHPSEF SMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFN NKKKPLKHVSKWKSIADCIQLKPDIIIHEKGHQPTASTFHTEGNNLADKLATQGSYVVN |
| SFVCP_Q87040 | 8,117 | MNPLQLLQPLPAEVKGTKLLAHWNSGATITCIPESFLEDEQPIKQTLIKTIHGEKQQNVYLTFKVKGRKVEAEVIASPYEYILLSPTDVPWLTQQPLQLTI LVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTP VYPVPKPDGRWRMVLDYREVNKTIPLTAAQNQHSAGILATIVRQKYKTTLDLANGFWAHPITPDSYWLTAFTWQGKQYCWTRLPQGFLNSPALFNAD AVDLLKEVPNVQVYVDDIYLSHDNPHEHIQQLEKVFQILLQAGYVINGKLVFIEALNTASNLEERLPDQRLVIKVNTSPSAGYVRYYNESGKKFPIMYLNYVFSKAELKFSMLE ARNFIPNFAELVQTLYNLIASSKGKYIEWTEDNTKQLNKVIEALNTASNLEERLPDQRLVIKVNTSPSAGYVRYYNESGKKFPIMYLNYVFSKAELKFSMLE KLLTTMHKALIKAMDLAMGQEILVYSPIVSMTKIQKTPLPERKALPIRWITMWTYLEDPRIQFHYDKTLPELKHIPDVYTSSIPPLKHPSQYEGVFCTDGSA IKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISK WKSIAECLSIKPDITIQHEKGHQPINTSIHTEGNALADKLATQGSYVVN |
| SFVCP_Q87040_2mut | 8,118 | MNPLQLLQPLPAEVKGTKLLAHWNSGATITCIPESFLEDEQPIKQTLIKTIHGEKQQNVYLTFKVKGRKVEAEVIASPYEYILLSPTDVPWLTQQPLQLTI LVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTP VYPVPKPDGRWRMVLDYREVNKTIPLTAAQNQHSAGILATIVRQKYKTTLDLANGFWAHPITPDSYWLTAFTWQGKQYCWTRLPQGFLNSPALFNAD AVDLLKEVPNVQVYVDDIYLSHDNPHEHIQQLEKVFQILLQAGYVSPGKYIEWTEDNTKQLNKVIEALNTASNLEERLPDQRLVIKVNTSPSAGYVRYYNESGKKFPIMYLNYVFSKAELKFSMLE ARNFIPNFAELVQTLYNLIASSPGKYIEWTEDNTKQLNKVIEALNTASNLEERLPDQRLVIKVNTSPSAGYVRYYNESGKKFPIMYLNYVFSKAELKFSMLE KLLTTMHKALIKAMDLAMGQEILVYSPIVSMTKIQKTPLPERKALPIRWITMWTYLEDPRIQFHYDKTLPELKHIPDVYTSSIPPLKHPSQYEGVFCTDGSA IKSPDPTKSNNAGMGIVHAIYNPEYKILNQWSIPLGHHTAQMAEIAAVEFACKKALKVPGPVLVITDSFYVAESANKELPYWKSNGFVNNKKEPLKHISK WKSIAECLSIKPDITIQHEKGHQPINTSIHTEGNALADKLATQGSYVVN |
| SFVCP_Q87040_2mutA | 8,119 | MNPLQLLQPLPAEVKGTKLLAHWNSGATITCIPESFLEDEQPIKQTLIKTIHGEKQQNVYLTFKVKGRKVEAEVIASPYEYILLSPTDVPWLTQQPLQLTI LVPLQEYQDRILNKTALPEEQKQQLKALFTKYDNLWQHWENQVGHRKIRPHNIATGDYPPRPQKQYPINPKAKPSIQIVIDDLLKQGVLTPQNSTMNTP VYPVPKPDGRWRMVLDYREVNKTIPLTAAQNQHSAGILATIVRQKYKTTLDLANGFWAHPITPDSYWLTAFTWQGKQYCWTRLPQGFLNSPALFNAD AVDLLKEVPNVQVYVDDIYLSHDNPHEHIQQLEKVFQILLQAGYVSLKKSEIGQRTVEFLGFNITKEGRGLTDTFKTKLLNVTPPKDLKQLQSILGKLNF ARNFIPNFAELVQTLYNLIASSPGKYIEWTEDNTKQLNKVIEALNTASNLEERLPDQRLVIKVNTSPSAGYVRYYNESGKKFPIMYLNYVFSKAELKFSMLE |

TABLE 6-continued

Exemplary reverse transcriptase domains from retroviruses

| RT Name | SEQ ID NO: | RT amino acid sequence |
|---|---|---|
| | | KLLTTMHKCALIKAMDLAMGQEILVYSPIVSMTKIQKTPLPERKALPIRWITWMTYLEDPRIQFHYDKTLPELKHIPDVTSSIPPLKHPSQYEGVFCTDGSA IKSPDPTKSNNAGMGIVHAIYNPEYKILNQWSIPLGHHTAQMAEIAAVEFACKKALKVPGPVLITDSFYVAESANKELPYWKSNGFVNNKKEPLKHISK WKSIAECLSIKPDITIQHEKGHQPINTSIHTEGNALADKLATQGSYVVN |
| SFVCP_Q87040-Pro | 8,120 | VPWLTQQPLQLTIIVPLQEYQDRILNKTILNKTALPEQKQQLKALFTKYDNLMQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNHSAGILATIVRQKYKTTLDLANGFWAHPITPDSYWLTAFTWQGKQYCWTRLPQ GFLNSPALFTADAVDLLKEVPNVQVYVDDIYLSHDNPHEHIQQLEKVFQILLQAGYVVSLKKSEIGQRTVEFLGFNIITKEGRGLTDFTFKTKLLNVTPPKDL KQLQSILGLLNFARNFIPNFAELVQTLYNLLIASSKGYIEWTEDNTKQLNKVIEALNTASNLEERLPDQRLVIKVNTSPSAGVVRYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLITDSFYVAESANKELPYWKSNGF VNNKKEPLKHISKWKSIAECLSIKPDITIQHEKGHQPINTSIHTEGNALADKLATQGSYVVN |
| SFVCP_Q87040-Pro_2mut | 8,121 | VPWLTQQPLQLTIIVPLQEYQDRILNKTALPEQKQQLKALFTKYDNLMQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNHSAGILATIVRQKYKTTLDLANGFWAHPITPDSYWLTAFTWQGKQYCWTRLPQ GFLNSPALFNADAVDLLKEVPNVQVYVDDIYLSHDNPHEHIQQLEKVFQILLQAGYVVSLKKSEIGQRTVEFLGFNIITKEGRGLTDFTFKTKLLNVTPPKDL KQLQSILGLLNFARNFIPNFAELVQTLYNLLIASSPGKYIEWTEDNTKQLNKVIEALNTASNLEERLPDQRLVIKVNTSPSAGVVRYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLITDSFYVAESANKELPYWKSNGF VNNKKEPLKHISKWKSIAECLSIKPDITIQHEKGHQPINTSIHTEGNALADKLATQGSYVVN |
| SFVCP_Q87040-Pro_2mutA | 8,122 | VPWLTQQPLQLTIIVPLQEYQDRILNKTALPEQKQQLKALFTKYDNLMQHWENQVGHRKIRPHNIATGDYPPRPQKQYPINPKAKPSIQIVIDDLLKQG VLTPQNSTMNTPVYPVPKPDGRWRMVLDYREVNKTIPLTAAQNHSAGILATIVRQKYKTTLDLANGFWAHPITPDSYWLTAFTWQGKQYCWTRLPQ GFLNSPALFNADAVDLLKEVPNVQVYVDDIYLSHDNPHEHIQQLEKVFQILLQAGYVVSLKKSEIGQRTVEFLGFNIITKEGRGLTDFTFKTKLLNVTPPKDL KQLQSILGKLNFARNFIPNFAELVQTLYNLLIASSPGKYIEWTEDNTKQLNKVIEALNTASNLEERLPDQRLVIKVNTSPSAGVVRYNESGKKPIMYLNYV FSKAELKFSMLEKLLTTMHKALIKAMDLAMGQEILVYSPIVSMTKIQKTPLPERKALPIRWITWMTYLEDPRIQFHYDKTLPELKHIPDVYTSSIPPLKHPS QYEGVFCTDGSAIKSPDPTKSNNAGMGIVHAIYNPEYKILNQWSIPLGHHTAQMAEIAAVEFACKKALKVPGPVLITDSFYVAESANKELPYWKSNGF VNNKKEPLKHISKWKSIAECLSIKPDITIQHEKGHQPINTSIHTEGNALADKLATQGSYVVN |
| SMRVH_P03364 | 8,123 | PRSRAIDIPVPHADKISWKITDPVWDQWPLIYEKTLAAIALVQEQLAAGHIEPTNSPWNTPIFIIKKKSGSWRLLQDLRAVNKVMVPMGALQPGLPSPV AIPLNYHKIVIDLKDCFFTIPLHPEDRPYFAFSVPQINFQSPMPRYQWKVLPQGMANSPTLCQKFVAAAIAPVRSQWPEAYILHYMDDILLACSDSAERAAK ACYAHIISCLTSYGLKIAPDKVQSEPPSYLGFELHHQQVFTPRVCLKTDHLKTLNDFQKLLGDIQWLRPYLKLPTSALVPLNNILKGRYTGPLSVRALTPE TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |
| SMRVH_P03364_2mut | 8,124 | PRSRAIDIPVPHADKISWKITDPVWDQWPLIYEKTLAAIALVQEQLAAGHIEPTNSPWNTPIFIIKKKSGSWRLLQDLRAVNKVMVPMGALQPGLPSPV AIPLNYHKIVIDLKDCFFTIPLHPEDRPYFAFSVPQINFQSPMPRYQWKVLPQGMANSPTLCQKFVAAAIAPVRSQWPEAYILHYMDDILLACDSAERAAK ACYAHIISCLTSYGLKIAPDKVQSEPPSYLGFELHHQQVFTPRVCLKTDHLKTLNDFQKLLGDIQWLRPYLKLPTSSLLAMLIIKGRYTGRLFGRDPHSIIIPY AKQSLALINKAIQNQSVQQISYNLPLVLLLLPTPHTPTAVFWQPNGTDPTKNGSPLLWLHLPASPSKVLLTYPSLLAMLIIKGRYTGRLFGRDPHSIIIPY TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |
| SMRVH_P03364_2mutB | 8,125 | PRSRAIDIPVPHADKISWKITDPVWDQWPLIYEKTLAAIALVQEQLAAGHIEPTNSPWNTPIFIIKKKSGSWRLLQDLRAVNKVMVPMGALQPGLPSPV APPLNYHKIVIDLKDCFFTIPLHPEDRPYFAFSVPQINFQSPMPRYQWKVLPQGMANSPTLCQKFVAAAIAPVRSQWPEAYILHYMDDILLACDSAERAAK ACYAHIISCLTSYGLKIAPDKVQSEPPSYLGFELHHQQVFTPRVCLKTDHLKTLNDFQKLLGDIQWLRPYLKLPTSSLVPLNNILKGRYTGRLFGRDPHSIIIPY AKQSLALINKAIQNQSVQQISYNLPLVLLLLPTPHTPTAVFWQPNGTDPTKNGSPLLWLHLPASPSKVLLTYPSLLAMLIIKGRYTGRLFGRDPHSIIIPY TQDQLTWLLQTSDEWAIALSSFTGDIDNHYPSDPVIQFAKLHQFIFPKITKCAPIPQATLVFTDGSSNGIAAYVIDNQPISIKSPYLSAQLVELYAILQVFTV LAHQPFNLYTDSAYIAQSVPLLETVPFIKSSTNATPLFSKLQQLILNRQHPFFIGHLRAHLNLPGPLAEGNALADAATQIFPIISD |

TABLE 6-continued

Exemplary reverse transcriptase domains from retroviruses

| RT Name | SEQ ID NO: | RT amino acid sequence |
|---|---|---|
| SRV2_P51517 | 8,126 | LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLP SPVAIPQGYFKIVIDLKDCFFTIPLPQVDQKRRAFSLPSTNFKQPMKRYQWKVLPQGMANSPTLCQKYVAAAIEPVRKSWAQMYIIHYMDDILIAGKLGE QVLQCFAQLKQALTTGLQIAPEKVQLQDPYTTYLGFQINGPKITNQKAVIRRDKLQTLNDFQKLLGDINWLRPYLHLTTGDLKPLFDILKGDSNPNSPRS LSEAALASLQKVETAIABQFVTQIDYTQPLTFLIFNTLTPTGLFWQNNPVMWVHLPASPKKVLLPYYDAIADLIILGRDNSKKYFGLEPSTIIQPYSKSQIH WLMQNTETWPIACASYAGNIDNHYPPNKLIQFCKLHAVVFPRIISKTPLDNALLVFTDGSSTGIAAYTFEKTVRFKTSHTSAQLVELQALIAVLSAPPHR ALNVYTDSAYLAHSIPLLETVSHIKHISDTAKFFLQCQQLIYNRSIPFYLGHIRAHSGLPGPLSQGNHITDLATKVVATTLTT |
| SRV2_P51517_2mutB | 8,127 | LATAVDILAPQRYADPITWKSDEPVWVDQWPLTQEKLAAAQQLVQEQLQAGHIIESNSPWNTPIFVIKKKSGKWRLLQDLRAVNATMVLMGALQPGLP SPVAPPQGYFKIVIDLKDCFFTIPLPQVDQKRRAFSLPSTNFKQPMKRYQWKVLPQGMANSPTLCQKYVAAAIEPVRKSWAQMYIIHYMDDILIAGKLGE QVLQCFAQLKQALTTGLQIAPEKVQLQDPYTTYLGFQINGPKITNQKAVIRRDKLQTLNDFQKLLGDINWLRPYLHLTTGDLKPLFDILKGDSNPNSPRS LSEAALASLQKVETAIABQFVTQIDYTQPLTFLIFNTLTPTGLFWQNNPVMWVHLPASPKKVLLPYYDAIADLIILGRDNSKKYFGLEPSTIIQPYSKSQIH WLMQNTETWPIACASYAGNIDNHYPPNKLIQFCKLHAVVFPRIISKTPLDNALLVFTDGSSTGIAAYTFEKTVRFKTSHTSAQLVELQALIAVLSAPPHR ALNVYTDSAYLAHSIPLLETVS TABLE 6-continued Exemplary reverse transcriptase domains from retroviruses

| RT Name | SEQ ID NO: | RT amino acid sequence |
|---|---|---|
| WMSV_P03359_3mut | 8,132 | VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLL PVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSP TLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPP TTPRQVREFLGTAGFCRLWIPGASLAAPLYPLTKPSIPFIWTEEHQKAFDRIKEALLSAPALALPDLTKPFTLYVDERAGVARGVLTQTLGPWRRPVAY LSKKLDPVASGWPTCLKAVAAVLLLKDADKLTLGQNVTVIASHSLESIVRQPPDRWMTNARMTHYQSLLLNERVSFAPPAVLNPATLLPVESEATPVH RCSEILAEETGTRRDLKDQPLPGVPAWTDGSSFIAEGKRRAGAAIVDGKRTVWASSLPEGTSAQKAELVALTQALRLAEGKDINIYTDSRYAFATAHI HGAIYKQRGWLTSAGKDIKNKEEILALLEAIHLPKRVAIIHCPGHQKGNDPVATGNRRADEAAKQAALSTRVLAETTKP |
| WMSV_P03359_3mutA | 8,133 | VLNLEEEYRLHEKPVPSSIDPSWLQLFPTVWAERAGMGLANQVPPVVVELRSGASPVAVRQYPMSKEAREGIRPHIQRFLDLGVLVPCQSPWNTPLL PVKKPGTNDYRPVQDLREINKRVQDIHPTVPNPYNLLSSLPPSHTWYSVLDLKDAFFCLKLHPNSQPLFAFEWRDPEKGNTGQLTWTRLPQGFKNSP TLFNEALHRDLAPFRALNPQVVLLQYVDDLLVAAPTYRDCKEGTQKLLQELSKLGYRVSAKKAQLCQKEVTYLGYLLKEGKRWLTPARKATVMKIPPP TTPRQVREFLGKAGFCRLFIPGFASLAAPLYPLTKPSIPFIWTEEHQKAFDRIKEALLSAPALALPDLTKPFTLYVDERAGVARGVLTQTLGPWRRPVAY LSKKLDPVASGWPTCLKAVAAVLLLKDADKLTLGQNVTVIASHSLESIVRQPPDRWMTNARMTHYQSLLLNERVSFAPPAVLNPATLLPVESEATPVH RCSEILAEETGTRRDLKDQPLPGVPAWTDGSSFIAEGKRRAGAAIVDGKRTVWASSLPEGTSAQKAELVALTQALRLAEGKDINIYTDSRYAFATAHI HGAIYKQRGWLTSAGKDIKNKEEILALLEAIHLPKRVAIIHCPGHQKGNDPVATGNRRADEAAKQAALSTRVLAETTKP |
| XMRV6_A1Z651 | 8,134 | TLNIEDEYRLHETSKEPDVPLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFDEALHRDLADFRIQHPDLILLQYVDDLLIAATSEQDCQRGTRALLQTLGNLGYRASAKKAQICQKQVKYLGYLLKEGQRWLTEARKETVMGQPTPK TPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEA PHDCLEILAETHGTRPDLTDQPIPDADYTWYTDGSSFLQEGQRRAGAAVTTETEVIWARALPAGTSAQRAELIALTQALKMAEGKKLNVYTDSRYAFT ANVHGEIYRRRGWLTSEGREIKNKNEILALLKALFLPKRLSIIHCPGHQKGNSAEARGNRMADQAAREAAMKAVLETSTLL |
| XMRV6_A1Z651_3mut | 8,135 | TLNIEDEYRLHETSKEPDVPLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSEQDCQRGTRALLQTLGNLGYRASAKKAQICQKQVKYLGYLLKEGQRWLTEARKETVMGQPTPK TPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPV AYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKE APHDCLEILAETHGTRPDLTDQPIPDADYTWYTDGSSFLQEGQRAGAAVTTETEVIWARALPAGTSAQRAELIALTQALKMAEGKKLNVYTDSRYAF ATAHVHGEIYRRRGWLTSEGREIKNKNEILALLKALFLPKRLSIIHCPGHQKGNSAEARGNRMADQAAREAAMKAVLETSTLL |
| XMRV6_A1Z651_3mutA | 8,136 | TLNIEDEYRLHETSKEPDVPLGSTWLSDFPQAWAETGMGLAVRQAPLIIPLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPT LFNEALHRDLADFRIQHPDLILLQYVDDLLLAATSEQDCQRGTRALLQTLGNLGYRASAKKAQICQKQVKYLGYLLKEGQRWLTEARKETVMGQPTPK TPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVA YLSKKLDPVAAGWPPCLRMVAAIAVLTKDAGKLTMGQPLVILAPHAVEALVKQPPDRWLSNARMTHYQAMLLDTDRVQFGPVVALNPATLLPLPEKEA PHDCLEILAETHGTRPDLTDQPIPDADYTWYTDGSSFLQEGQRRAGAAVTTETEVIWARALPAGTSAQRAELIALTQALKMAEGKKLNVYTDSRYAFAT AHVHGEIYRRRGWLTSEGREIKNKNEILALLKALFLPKRLSIIHCPGHQKGNSAEARGNRMADQAAREAAMKAVLETSTLL |

In some embodiments, reverse transcriptase domains are modified, for example by site-specific mutation. In some embodiments, reverse transcriptase domains are engineered to have improved properties, e.g. SuperScript IV (SSIV) reverse transcriptase derived from the MMLV RT. In some embodiments, the reverse transcriptase domain may be engineered to have lower error rates, e.g., as described in WO2001068895, incorporated herein by reference. In some embodiments, the reverse transcriptase domain may be engineered to be more thermostable. In some embodiments, the reverse transcriptase domain may be engineered to be more processive. In some embodiments, the reverse transcriptase domain may be engineered to have tolerance to inhibitors. In some embodiments, the reverse transcriptase domain may be engineered to be faster. In some embodiments, the reverse transcriptase domain may be engineered to better tolerate modified nucleotides in the RNA template. In some embodiments, the reverse transcriptase domain may be engineered to insert modified DNA nucleotides. In some embodiments, the reverse transcriptase domain is engineered to bind a template RNA. In some embodiments, one or more mutations are chosen from D200N, L603W, T330P, D524G, E562Q, D583N, P53L, S67R, E67K, T197A, H204R, E302K, F309K, W313F, M35G, N454K, H594Q, L671P, E69K, H8Y, T306K, or D653N in the RT domain of murine leukemia virus reverse transcriptase or a corresponding mutation at a corresponding position of another RT domain.

In some embodiments, an RT domain (e.g., as listed in Table 6) comprises one or more mutations as listed in Table 2 below. In some embodiment, an RT domain as listed in Table 6 comprises one, two, three, four, five, or six of the mutations listed in the corresponding row of Table 2 below.

TABLE 2

Exemplary RT domain mutations (relative to corresponding wild-type sequences as listed in the corresponding row of Table 6)

| RT Domain Name | Mutation(s) | | | | |
|---|---|---|---|---|---|
| AVIRE_P03360 | | | | | |
| AVIRE_P03360_3mut | D200N | G330P | L605W | | |
| AVIRE_P03360_3mutA | D200N | G330P | L605W | T306K | W313F |
| BAEVM_P10272 | | | | | |
| BAEVM_P10272_3mut | D198N | E328P | L602W | | |
| BAEVM_P10272_3mutA | D198N | E328P | L602W | T304K | W311F |
| BLVAU_P25059 | | | | | |
| BLVAU_P25059_2mut | E159Q | G286P | | | |
| BLVJ_P03361 | | | | | |
| BLVJ_P03361_2mut | E159Q | L524W | | | |
| BLVJ_P03361_2mutB | E159Q | L524W | I97P | | |
| FFV_O93209 | D21N | | | | |
| FFV_O93209_2mut | D21N | T293N | T419P | | |
| FFV_O93209_2mutA | D21N | T293N | T419P | L393K | |
| FFV_O93209-Pro | | | | | |
| FFV_O93209-Pro_2mut | T207N | T333P | | | |
| FFV_O93209-Pro_2mutA | T207N | T333P | L307K | | |
| FLV_P10273 | | | | | |
| FLV_P10273_3mut | D199N | L602W | | | |
| FLV_P10273_3mutA | D199N | L602W | T305K | W312F | |
| FOAMV_P14350 | D24N | | | | |
| FOAMV_P14350_2mut | D24N | T296N | S420P | | |
| FOAMV_P14350_2mutA | D24N | T296N | S420P | L396K | |
| FOAMV_P14350-Pro | | | | | |
| FOAMV_P14350-Pro_2mut | T207N | S331P | | | |
| FOAMV_P14350-Pro_2mutA | T207N | S331P | L307K | | |
| GALV_P21414 | | | | | |
| GALV_P21414_3mut | D198N | E328P | L600W | | |
| GALV_P21414_3mutA | D198N | E328P | L600W | T304K | W311F |
| HTL1A_P03362 | | | | | |
| HTL1A_P03362_2mut | E152Q | R279P | | | |
| HTL1A_P03362_2mutB | E152Q | R279P | L90P | | |
| HTL1C_P14078 | | | | | |
| HTL1C_P14078_2mut | E152Q | R279P | | | |
| HTL1L_P0C211 | | | | | |
| HTL1L_P0C211_2mut | E149Q | L527W | | | |
| HTL1L_P0C211_2mutB | E149Q | L527W | L87P | | |
| HTL32_Q0R5R2 | | | | | |
| HTL32_Q0R5R2_2mut | E149Q | L526W | | | |
| HTL32_Q0R5R2_2mutB | E149Q | L526W | L87P | | |
| HTL3P_Q4U0X6 | | | | | |
| HTL3P_Q4U0X6_2mut | E149Q | L526W | | | |
| HTL3P_Q4U0X6_2mutB | E149Q | L526W | L87P | | |
| HTLV2_P03363_2mut | E147Q | G274P | | | |
| JSRV_P31623 | | | | | |
| JSRV_P31623_2mutB | A100P | | | | |
| KORV_Q9TTC1 | D32N | | | | |
| KORV_Q9TTC1_3mut | D32N | D322N | E452P | L724W | |
| KORV_Q9TTC1_3mutA | D32N | D322N | E452P | L724W | T428K | W435F |
| KORV_Q9TTC1-Pro | | | | | |
| KORV_Q9TTC1-Pro_3mut | D231N | E361P | L633W | | |
| KORV_Q9TTC1-Pro_3mutA | D231N | E361P | L633W | T337K | W344F |
| MLVAV_P03356 | | | | | |

TABLE 2-continued

Exemplary RT domain mutations (relative to corresponding wild-type sequences as listed in the corresponding row of Table 6)

| RT Domain Name | Mutation(s) | | | | |
|---|---|---|---|---|---|
| MLVAV_P03356_3mut | D200N | T330P | L603W | | |
| MLVAV_P03356_3mutA | D200N | T330P | L603W | T306K | W313F |
| MLVBM_Q7SVK7 | | | | | |
| MLVBM_Q7SVK7 | | | | | |
| MLVBM_Q7SVK7_3mut | D200N | T330P | L603W | | |
| MLVBM_Q7SVK7_3mut | D200N | T330P | L603W | | |
| MLVBM_Q7SVK7_3mutA_WS | D199N | T329P | L602W | T305K | W312F |
| MLVBM_Q7SVK7_3mutA_WS | D199N | T329P | L602W | T305K | W312F |
| MLVCB_P08361 | | | | | |
| MLVCB_P08361_3mut | D200N | T330P | L603W | | |
| MLVCB_P08361_3mutA | D200N | T330P | L603W | T306K | W313F |
| MLVF5_P26810 | | | | | |
| MLVF5_P26810_3mut | D200N | T330P | L603W | | |
| MLVF5_P26810_3mutA | D200N | T330P | L603W | T306K | W313F |
| MLVFF_P26809_3mut | D200N | T330P | L603W | | |
| MLVFF_P26809_3mutA | D200N | T330P | L603W | T306K | W313F |
| MLVMS_P03355 | | | | | |
| MLVMS_P03355 | | | | | |
| MLVMS_P03355_3mut | D200N | T330P | L603W | | |
| MLVMS_P03355_3mut | D200N | T330P | L603W | | |
| MLVMS_P03355_3mutA_WS | D200N | T330P | L603W | T306K | W313F |
| MLVMS_P03355_3mutA_WS | D200N | T330P | L603W | T306K | W313F |
| MLVMS_P03355_PLV919 | D200N | T330P | L603W | T306K | W313F | H8Y |
| MLVMS_P03355_PLV919 | D200N | T330P | L603W | T306K | W313F | H8Y |
| MLVRD_P11227 | | | | | |
| MLVRD_P11227_3mut | D200N | T330P | L603W | | |
| MMTVB_P03365 | D26N | | | | |
| MMTVB_P03365 | D26N | | | | |
| MMTVB_P03365_2mut | D26N | G401P | | | |
| MMTVB_P03365_2mut_WS | G400P | | | | |
| MMTVB_P03365_2mut_WS | G400P | | | | |
| MMTVB_P03365_2mutB | D26N | G401P | V215P | | |
| MMTVB_P03365_2mutB | D26N | G401P | V215P | | |
| MMTVB_P03365_2mutB_WS | G400P | V212P | | | |
| MMTVB_P03365_2mutB_WS | G400P | V212P | | | |
| MMTVB_P03365_WS | | | | | |
| MMTVB_P03365_WS | | | | | |
| MMTVB_P03365-Pro | | | | | |
| MMTVB_P03365-Pro | | | | | |
| MMTVB_P03365-Pro_2mut | G309P | | | | |
| MMTVB_P03365-Pro_2mut | G309P | | | | |
| MMTVB_P03365-Pro_2mutB | G309P | V123P | | | |
| MMTVB_P03365-Pro_2mutB | G309P | V123P | | | |
| MPMV_P07572 | | | | | |
| MPMV_P07572_2mutB | G289P | I103P | | | |
| PERV_Q4VFZ2 | | | | | |
| PERV_Q4VFZ2 | | | | | |
| PERV_Q4VFZ2_3mut | D199N | E329P | L602W | | |
| PERV_Q4VFZ2_3mut | D199N | E329P | L602W | | |
| PERV_Q4VFZ2_3mutA_WS | D196N | E326P | L599W | T302K | W309F |
| PERV_Q4VFZ2_3mutA_WS | D196N | E326P | L599W | T302K | W309F |
| SFV1_P23074 | D24N | | | | |
| SFV1_P23074_2mut | D24N | T296N | N420P | | |
| SFV1_P23074_2mutA | D24N | T296N | N420P | L396K | |
| SFV1_P23074-Pro | | | | | |
| SFV1_P23074-Pro_2mut | T207N | N331P | | | |
| SFV1_P23074-Pro_2mutA | T207N | N331P | L307K | | |
| SFV3L_P27401 | D24N | | | | |
| SFV3L_P27401_2mut | D24N | T296N | N422P | | |
| SFV3L_P27401_2mutA | D24N | T296N | N422P | L396K | |
| SFV3L_P27401-Pro | | | | | |
| SFV3L_P27401-Pro_2mut | T307N | N333P | | | |
| SFV3L_P27401-Pro_2mutA | T307N | N333P | L307K | | |
| SFVCP_Q87040 | D24N | | | | |
| SFVCP_Q87040_2mut | D24N | T296N | K422P | | |
| SFVCP_Q87040_2mutA | D24N | T296N | K422P | L396K | |
| SFVCP_Q87040-Pro | | | | | |
| SFVCP_Q87040-Pro_2mut | T207N | K333P | | | |
| SFVCP_Q87040-Pro_2mutA | T207N | K333P | L307K | | |
| SMRVH_P03364 | | | | | |
| SMRVH_P03364_2mut | G288P | | | | |
| SMRVH_P03364_2mutB | G288P | I102P | | | |
| SRV2_P51517 | | | | | |
| SRV2_P51517_2mutB | I103P | | | | |
| WDSV_O92815 | | | | | |

TABLE 2-continued

Exemplary RT domain mutations (relative to corresponding wild-type sequences as listed in the corresponding row of Table 6)

| RT Domain Name | Mutation(s) | | | |
|---|---|---|---|---|
| WDSV_O92815_2mut | S183N | K312P | | |
| WDSV_O92815_2mutA | S183N | K312P | L288K | W295F |
| WMSV_P03359 | | | | |
| WMSV_P03359_3mut | D198N | E328P | L600W | |
| WMSV_P03359_3mutA | D198N | E328P | L600W | T304K W311F |
| XMRV6_A1Z651 | | | | |
| XMRV6_A1Z651_3mut | D200N | T330P | L603W | |
| XMRV6_A1Z651_3mutA | D200N | T330P | L603W | T306K W313F |

In some embodiments, a gene modifying polypeptide comprises the RT domain from a retroviral reverse transcriptase, e.g., a wild-type M-MLV RT, e.g., comprising the following sequence:

M-MLV (WT):
(SEQ ID NO: 5002)
TLNIEDEYRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFDEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGTAGFCRLWIPGFAEMAAPLYPLTKTGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADHTWYTDGSSLLQEGQRKAGAA

VTTETEVIWAKALPAGTSAQRAELIALTQALKMAEGKKLNVYTDSRYAF

ATAHIHGEIYRRRGLLTSEGKEIKNKDEILALLKALFLPKRLSIIHCPG

HQKGHSAEARGNRMADQAARKAAITETPDTSTLLI

In some embodiments, a gene modifying polypeptide comprises the RT domain from a retroviral reverse transcriptase, e.g., an M-MLV RT, e.g., comprising the following sequence:

(SEQ ID NO: 5003)
TLNIEDEHRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFDEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGTAGFCRLWIPGFAEMAAPLYPLTKTGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADHTWYTDGSSLLQEGQRKAGAA

VTTETEVIWAKALPAGTSAQRAELIALTQALKMAEGKKLNVYTDSRYAF

ATAHIHGEIYRRRGLLTSEGKEIKNKDEILALLKALFLPKRLSIIHCPG

HQKGHSAEARGNRMADQAARKAAITETPDTSTLL

In some embodiments, a gene modifying polypeptide comprises the RT domain from a retroviral reverse transcriptase comprising the sequence of amino acids 659-1329 of NP_057933. In embodiments, the gene modifying polypeptide further comprises one additional amino acid at the N-terminus of the sequence of amino acids 659-1329 of NP_057933, e.g., as shown below:

(SEQ ID NO: 5004)
TLNIEDEHRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFDEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGTAGFCRLWIPGFAEMAAPLYPLTKTGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADH<u>TWYTDGSSLLQEGQRKAGAA</u>

<u>VTTETEVIWAKALPAGTSAQRAELIALTQALKMAEGKKLNVYTDSRYAF</u>

<u>ATAHIHGEIYRRRGLLTSEGKEIKNKDEILALLKALFLPKRLSIIHCPG</u>

<u>HQKGHSAEARGNRMADQAARKAA</u>

Core RT (bold), annotated per above
RNAseH (underlined), annotated per above

In embodiments, the gene modifying polypeptide further comprises one additional amino acid at the C-terminus of the sequence of amino acids 659-1329 of NP_057933. In embodiments, the gene modifying polypeptide comprises an RNaseH1 domain (e.g., amino acids 1178-1318 of NP_057933).

In some embodiments, a retroviral reverse transcriptase domain, e.g., M-MLV RT, may comprise one or more mutations from a wild-type sequence that may improve features of the RT, e.g., thermostability, processivity, and/or template binding. In some embodiments, an M-MLV RT domain comprises, relative to the M-MLV (WT) sequence above, one or more mutations, e.g., selected from D200N, L603W, T330P, T306K, W313F, D524G, E562Q, D583N, P51L, S67R, E67K, T197A, H204R, E302K, F309N, L435G, N454K, H594Q, D653N, R110S, K103L, e.g., a combination of mutations, such as D200N, L603W, and T330P, optionally further including T306K and W313F. In some embodiments, an M-MLV RT used herein comprises the mutations D200N, L603W, T330P, T306K and W313F. In embodiments, the mutant M-MLV RT comprises the following amino acid sequence:

M-MLV (PE2):
(SEQ ID NO: 5005)
TLNIEDEYRLHETSKEPDVSLGSTWLSDFPQAWAETGGMGLAVRQAPLI

IPLKATSTPVSIKQYPMSQEARLGIKPHIQRLLDQGILVPCQSPWNTPL

LPVKKPGTNDYRPVQDLREVNKRVEDIHPTVPNPYNLLSGLPPSHQWYT

VLDLKDAFFCLRLHPTSQPLFAFEWRDPEMGISGQLTWTRLPQGFKNSP

TLFNEALHRDLADFRIQHPDLILLQYVDDLLLAATSELDCQQGTRALLQ

TLGNLGYRASAKKAQICQKQVKYLGYLLKEGQRWLTEARKETVMGQPTP

KTPRQLREFLGKAGFCRLFIPGFAEMAAPLYPLTKPGTLFNWGPDQQKA

YQEIKQALLTAPALGLPDLTKPFELFVDEKQGYAKGVLTQKLGPWRRPV

AYLSKKLDPVAAGWPPCLRMVAAIAVLTKDAGKLTMGQPLVILAPHAVE

ALVKQPPDRWLSNARMTHYQALLLDTDRVQFGPVVALNPATLLPLPEEG

LQHNCLDILAEAHGTRPDLTDQPLPDADHTWYTDGSSLLQEGQRKAGAA

VTTETEVIWAKALPAGTSAQRAELIALTQALKMAEGKKLNVYTDSRYAF

ATAHIHGEIYRRRGWLTSEGKEIKNKDEILALLKALFLPKRLSIIHCPG

HQKGHSAEARGNRMADQAARKAAITETPDTSTLLI

In some embodiments, a writing domain (e.g., RT domain) comprises an RNA-binding domain, e.g., that specifically binds to an RNA sequence. In some embodiments, a template RNA comprises an RNA sequence that is specifically bound by the RNA-binding domain of the writing domain.

In some embodiments, the reverse transcription domain only recognizes and reverse transcribes a specific template, e.g., a template RNA of the system. In some embodiments, the template comprises a sequence or structure that enables recognition and reverse transcription by a reverse transcription domain. In some embodiments, the template comprises a sequence or structure that enables association with an RNA-binding domain of a polypeptide component of a genome engineering system described herein. In some embodiments, the genome engineering system reverse preferably transcribes a template comprising an association sequence over a template lacking an association sequence.

The writing domain may also comprise DNA-dependent DNA polymerase activity, e.g., comprise enzymatic activity capable of writing DNA into the genome from a template DNA sequence. In some embodiments, DNA-dependent DNA polymerization is employed to complete second-strand synthesis of a target site edit. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second-strand synthesis. In some embodiments, the DNA-dependent DNA polymerase activity is provided by a second polypeptide of the system. In some embodiments, the DNA-dependent DNA polymerase activity is provided by an endogenous host cell polymerase that is optionally recruited to the target site by a component of the genome engineering system.

In some embodiments, the reverse transcriptase domain has a lower probability of premature termination rate ($P_{off}$) in vitro relative to a reference reverse transcriptase domain. In some embodiments, the reference reverse transcriptase domain is a viral reverse transcriptase domain, e.g., the RT domain from M-MLV.

In some embodiments, the reverse transcriptase domain has a lower probability of premature termination rate ($P_{off}$) in vitro of less than about $5\times10^{-3}$/nt, $5\times10^{-4}$/nt, or $5\times10^{-6}$/nt, e.g., as measured on a 1094 nt RNA. In embodiments, the in vitro premature termination rate is determined as described in Bibillo and Eickbush (2002) J Biol Chem 277(38):34836-34845 (incorporated by reference herein its entirety).

In some embodiments, the reverse transcriptase domain is able to complete at least about 30% or 50% of integrations in cells. The percent of complete integrations can be measured by dividing the number of substantially full-length integration events (e.g., genomic sites that comprise at least 98% of the expected integrated sequence) by the number of total (including substantially full-length and partial) integration events in a population of cells. In embodiments, the integrations in cells is determined (e.g., across the integration site) using long-read amplicon sequencing, e.g., as described in Karst et al. (2020) bioRxiv doi.org/10.1101/645903 (incorporated by reference herein in its entirety).

In embodiments, quantifying integrations in cells comprises counting the fraction of integrations that contain at least about 75%, 80%, 85%, 90%, 95%, 96%, 97%, 98%, 99%, or 100% of the DNA sequence corresponding to the template RNA (e.g., a template RNA having a length of at least 0.05, 0.1, 0.5, 0.6, 0.7, 0.8, 0.9, 1, 1.5, 2, 3, 4, or 5 kb, e.g., a length between 0.5-0.6, 0.6-0.7, 0.7-0.8, 0.8-0.9, 1.0-1.2, 1.2-1.4, 1.4-1.6, 1.6-1.8, 1.8-2.0, 2-3, 3-4, or 4-5 kb).

In some embodiments, the reverse transcriptase domain is capable of polymerizing dNTPs in vitro. In embodiments, the reverse transcriptase domain is capable of polymerizing dNTPs in vitro at a rate between 0.1-50 nt/sec (e.g., between 0.1-1, 1-10, or 10-50 nt/sec). In embodiments, polymerization of dNTPs by the reverse transcriptase domain is measured by a single-molecule assay, e.g., as described in Schwartz and Quake (2009) PNAS 106(48):20294-20299 (incorporated by reference in its entirety).

In some embodiments, the reverse transcriptase domain has an in vitro error rate (e.g., misincorporation of nucleotides) of between $1\times10^{-3}$-$1\times10^{-4}$ or $1\times10^{-4}$-$1\times10^{-5}$ substitutions/nt, e.g., as described in Yasukawa et al. (2017) Biochem Biophys Res Commun 492(2):147-153 (incorporated herein by reference in its entirety). In some embodiments, the reverse transcriptase domain has an error rate (e.g., misincorporation of nucleotides) in cells (e.g., HEK293T cells) of between $1\times10^{-3}$-$1\times10^{-4}$ or $1\times10^{-4}$-$1\times10^{-5}$ substitutions/nt, e.g., by long-read amplicon sequencing, e.g., as described in Karst et al. (2020) bioRxiv doi.org/10.1101/645903 (incorporated by reference herein in its entirety).

In some embodiments, the reverse transcriptase domain is capable of performing reverse transcription of a target RNA in vitro. In some embodiments, the reverse transcriptase requires a primer of at least 3 nucleotides to initiate reverse transcription of a template. In some embodiments, reverse transcription of the target RNA is determined by detection of cDNA from the target RNA (e.g., when provided with a ssDNA primer, e.g., which anneals to the target with at least 3, 4, 5, 6, 7, 8, 9, or 10 nt at the 3' end), e.g., as described in Bibillo and Eickbush (2002) *J Biol Chem* 277(38):34836-34845 (incorporated herein by reference in its entirety).

In some embodiments, the reverse transcriptase domain performs reverse transcription at least 5 or 10 times more efficiently (e.g., by cDNA production), e.g., when converting its RNA template to cDNA, for example, as compared to an RNA template lacking the protein binding motif (e.g., a 3' UTR). In embodiments, efficiency of reverse transcription is measured as described in Yasukawa et al. (2017) *Biochem Biophys Res Commun* 492(2):147-153 (incorporated by reference herein in its entirety).

In some embodiments, the reverse transcriptase domain specifically binds a specific RNA template with higher frequency (e.g., about 5 or 10-fold higher frequency) than any endogenous cellular RNA, e.g., when expressed in cells (e.g., HEK293T cells). In embodiments, frequency of specific binding between the reverse transcriptase domain and the template RNA are measured by CLIP-seq, e.g., as described in Lin and Miles (2019) *Nucleic Acids Res* 47(11): 5490-5501 (incorporated herein by reference in its entirety).

Template Nucleic Acid Binding Domain

The gene modifying polypeptide typically contains regions capable of associating with the template nucleic acid (e.g., template RNA). In some embodiments, the template nucleic acid binding domain is an RNA binding domain. In some embodiments, the RNA binding domain is a modular domain that can associate with RNA molecules containing specific signatures, e.g., structural motifs. In other embodiments, the template nucleic acid binding domain (e.g., RNA binding domain) is contained within the reverse transcription domain, e.g., the reverse transcriptase-derived component has a known signature for RNA preference.

In other embodiments, the template nucleic acid binding domain (e.g., RNA binding domain) is contained within the target DNA binding domain. For example, in some embodiments, the DNA binding domain is a CRISPR-associated protein that recognizes the structure of a template nucleic acid (e.g., template RNA) comprising a gRNA. In some embodiments, a gene modifying polypeptide comprises a DNA-binding domain comprising a CRISPR-associated protein that associates with a gRNA scaffold that allows the DNA-binding domain to bind a target genomic DNA sequence. In some embodiments, the gRNA scaffold and gRNA spacer is comprised within the template nucleic acid (e.g., template RNA), thus the DNA-binding domain is also the template nucleic acid binding domain. In some embodiments, the polypeptide possesses RNA binding function in multiple domains, e.g., can bind a gRNA structure in a CRISPR-associated DNA binding domain and an additional sequence or structure in a reverse transcriptase domain.

In some embodiments, the RNA binding domain is capable of binding to a template RNA with greater affinity than a reference RNA binding domain. In some embodiments, the reference RNA binding domain is an RNA binding domain from Cas9 of *S. pyogenes*. In some embodiments, the RNA binding domain is capable of binding to a template RNA with an affinity between 100 pM-10 nM (e.g., between 100 pM-1 nM or 1 nM-10 nM). In some embodiments, the affinity of a RNA binding domain for its template RNA is measured in vitro, e.g., by thermophoresis, e.g., as described in Asmari et al. Methods 146:107-119 (2018) (incorporated by reference herein in its entirety). In some embodiments, the affinity of a RNA binding domain for its template RNA is measured in cells (e.g., by FRET or CLIP-Seq).

In some embodiments, the RNA binding domain is associated with the template RNA in vitro at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019) *Nucleic Acids Res* 47(11):5490-5501 (incorporated by reference herein in its entirety). In some embodiments, the RNA binding domain is associated with the template RNA in cells (e.g., in HEK293T cells) at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019), supra.

Endonuclease Domains and DNA Binding Domains

In some embodiments, a gene modifying polypeptide possesses the function of DNA target site cleavage via an endonuclease domain. In some embodiments, a gene modifying polypeptide comprises a DNA binding domain, e.g., for binding to a target nucleic acid. In some embodiments, a domain (e.g., a Cas domain) of the gene modifying polypeptide comprises two or more smaller domains, e.g., a DNA binding domain and an endonuclease domain. It is understood that when a DNA binding domain (e.g., a Cas domain) is said to bind to a target nucleic acid sequence, in some embodiments, the binding is mediated by a gRNA.

In some embodiments, a domain has two functions. For example, in some embodiments, the endonuclease domain is also a DNA-binding domain. In some embodiments, the endonuclease domain is also a template nucleic acid (e.g., template RNA) binding domain. For example, in some embodiments, a polypeptide comprises a CRISPR-associated endonuclease domain that binds a template RNA comprising a gRNA, binds a target DNA sequence (e.g., with complementarity to a portion of the gRNA), and cuts the target DNA sequence. In some embodiments, an endonuclease domain or endonuclease/DNA-binding domain from a heterologous source can be used or can be modified (e.g., by insertion, deletion, or substitution of one or more residues) in a gene modifying system described herein.

In some embodiments, a nucleic acid encoding the endonuclease domain or endonuclease/DNA binding domain is altered from its natural sequence to have altered codon usage, e.g. improved for human cells. In some embodiments, the endonuclease element is a heterologous endonuclease element, such as a Cas endonuclease (e.g., Cas9), a type-II restriction endonuclease (e.g., Fok1), a meganuclease (e.g., I-SceI), or other endonuclease domain.

In certain aspects, the DNA-binding domain of a gene modifying polypeptide described herein is selected, designed, or constructed for binding to a desired host DNA target sequence. In certain embodiments, the DNA-binding domain of the polypeptide is a heterologous DNA-binding element. In some embodiments the heterologous DNA binding element is a zinc-finger element or a TAL effector element, e.g., a zinc-finger or TAL polypeptide or functional fragment thereof. In some embodiments the heterologous DNA binding element is a sequence-guided DNA binding element, such as Cas9, Cpf1, or other CRISPR-related protein that has been altered to have no endonuclease activity. In some embodiments the heterologous DNA binding element retains endonuclease activity. In some embodiments, the heterologous DNA binding element retains partial endonuclease activity to cleave ssDNA, e.g., possesses nickase activity. In specific embodiments, the heterologous DNA-binding domain can be any one or more of Cas9, TAL domain, ZF domain, Myb domain, combinations thereof, or multiples thereof.

In some embodiments, DNA-binding domains are modified, for example by site-specific mutation, increasing or decreasing DNA-binding elements (for example, number and/or specificity of zinc fingers), etc., to alter DNA-binding specificity and affinity. In some embodiments a nucleic acid sequence encoding the DNA binding domain is altered from its natural sequence to have altered codon usage, e.g. improved for human cells. In embodiments, the DNA binding domain comprises one or more modifications relative to a wild-type DNA binding domain, e.g., a modification via directed evolution, e.g., phage-assisted continuous evolution (PACE).

In some embodiments, the DNA binding domain comprises a meganuclease domain (e.g., as described herein, e.g., in the endonuclease domain section), or a functional fragment thereof. In some embodiments, the meganuclease domain possesses endonuclease activity, e.g., double-strand cleavage and/or nickase activity. In other embodiments, the meganuclease domain has reduced activity, e.g., lacks endonuclease activity, e.g., the meganuclease is catalytically inactive. In some embodiments, a catalytically inactive meganuclease is used as a DNA binding domain, e.g., as described in Fonfara et al. Nucleic Acids Res 40(2):847-860 (2012), incorporated herein by reference in its entirety.

In some embodiments, a gene modifying polypeptide comprises a modification to a DNA-binding domain, e.g., relative to the wild-type polypeptide. In some embodiments, the DNA-binding domain comprises an addition, deletion, replacement, or modification to the amino acid sequence of the original DNA-binding domain. In some embodiments, the DNA-binding domain is modified to include a heterologous functional domain that binds specifically to a target nucleic acid (e.g., DNA) sequence of interest. In some embodiments, the functional domain replaces at least a portion (e.g., the entirety of) the prior DNA-binding domain of the polypeptide. In some embodiments, the functional domain comprises a zinc finger (e.g., a zinc finger that specifically binds to the target nucleic acid (e.g., DNA) sequence of interest. In some embodiments, the functional domain comprises a Cas domain (e.g., a Cas domain that specifically binds to the target nucleic acid (e.g., DNA) sequence of interest. In some embodiments, the Cas domain comprises a Cas9 or a mutant or variant thereof (e.g., as described herein). In embodiments, the Cas domain is associated with a guide RNA (gRNA), e.g., as described herein. In embodiments, the Cas domain is directed to a target nucleic acid (e.g., DNA) sequence of interest by the gRNA. In embodiments, the Cas domain is encoded in the same nucleic acid (e.g., RNA) molecule as the gRNA. In embodiments, the Cas domain is encoded in a different nucleic acid (e.g., RNA) molecule from the gRNA.

In some embodiments, the DNA binding domain is capable of binding to a target sequence (e.g., a dsDNA target sequence) with greater affinity than a reference DNA binding domain. In some embodiments, the reference DNA binding domain is a DNA binding domain from Cas9 of *S. pyogenes*. In some embodiments, the DNA binding domain is capable of binding to a target sequence (e.g., a dsDNA target sequence) with an affinity between 100 pM-10 nM (e.g., between 100 pM-1 nM or 1 nM-10 nM).

In some embodiments, the affinity of a DNA binding domain for its target sequence (e.g., dsDNA target sequence) is measured in vitro, e.g., by thermophoresis, e.g., as described in Asmari et al. Methods 146:107-119 (2018) (incorporated by reference herein in its entirety).

In embodiments, the DNA binding domain is capable of binding to its target sequence (e.g., dsDNA target sequence), e.g, with an affinity between 100 pM-10 nM (e.g., between 100 pM-1 nM or 1 nM-10 nM) in the presence of a molar excess of scrambled sequence competitor dsDNA, e.g., of about 100-fold molar excess.

In some embodiments, the DNA binding domain is found associated with its target sequence (e.g., dsDNA target sequence) more frequently than any other sequence in the genome of a target cell, e.g., human target cell, e.g., as measured by ChIP-seq (e.g., in HEK293T cells), e.g., as described in He and Pu (2010) *Curr. Protoc Mol Biol* Chapter 21 (incorporated herein by reference in its entirety). In some embodiments, the DNA binding domain is found associated with its target sequence (e.g., dsDNA target sequence) at least about 5-fold or 10-fold, more frequently than any other sequence in the genome of a target cell, e.g., as measured by ChIP-seq (e.g., in HEK293T cells), e.g., as described in He and Pu (2010), supra.

In some embodiments, the endonuclease domain has nickase activity and cleaves one strand of a target DNA. In some embodiments, nickase activity reduces the formation of double-stranded breaks at the target site. In some embodiments, the endonuclease domain creates a staggered nick structure in the first and second strands of a target DNA. In some embodiments, a staggered nick structure generates free 3' overhangs at the target site. In some embodiments, free 3' overhangs at the target site improve editing efficiency, e.g., by enhancing access and annealing of a 3' homology region of a template nucleic acid. In some embodiments, a staggered nick structure reduces the formation of double-stranded breaks at the target site.

In some embodiments, the endonuclease domain cleaves both strands of a target DNA, e.g., results in blunt-end cleavage of a target with no ssDNA overhangs on either side of the cut-site. The amino acid sequence of an endonuclease domain of a gene modifying system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain described herein, e.g., an endonuclease domain as described herein.

In certain embodiments, the heterologous endonuclease is FokI or a functional fragment thereof. In certain embodiments, the heterologous endonuclease is a Holliday junction resolvase or homolog thereof, such as the Holliday junction resolving enzyme from *Sulfolobus solfataricus* Ssol Hje (Govindaraju et al., *Nucleic Acids Research* 44:7, 2016). In certain embodiments, the heterologous endonuclease is the endonuclease of the large fragment of a spliceosomal protein, such as Prp8 (Mahbub et al., *Mobile DNA* 8:16, 2017). In certain embodiments, the heterologous endonuclease is derived from a CRISPR-associated protein, e.g., Cas9. In certain embodiments, the heterologous endonuclease is engineered to have only ssDNA cleavage activity, e.g., only nickase activity, e.g., be a Cas9 nickase, e.g., SpCas9 with D10A, H840A, or N863A mutations. Table 8 provides exemplary Cas proteins and mutations associated with nickase activity. In still other embodiments, homologous endonuclease domains are modified, for example by site-specific mutation, to alter DNA endonuclease activity. In still other embodiments, endonuclease domains are modified to reduce DNA-sequence specificity, e.g., by truncation to remove domains that confer DNA-sequence specificity or mutation to inactivate regions conferring DNA-sequence specificity.

In some embodiments, the endonuclease domain has nickase activity and does not form double-stranded breaks. In some embodiments, the endonuclease domain forms single-stranded breaks at a higher frequency than double-stranded breaks, e.g., at least 90%, 95%, 96%, 97%, 98%, or 99% of the breaks are single-stranded breaks, or less than 10%, 5%, 4%, 3%, 2%, or 1% of the breaks are double-stranded breaks. In some embodiments, the endonuclease forms substantially no double-stranded breaks. In some embodiments, the endonuclease does not form detectable levels of double-stranded breaks.

In some embodiments, the endonuclease domain has nickase activity that nicks the target site DNA of the first strand; e.g., in some embodiments, the endonuclease domain cuts the genomic DNA of the target site near to the site of alteration on the strand that will be extended by the writing domain. In some embodiments, the endonuclease domain has nickase activity that nicks the target site DNA of the first strand and does not nick the target site DNA of the second strand. For example, when a polypeptide comprises a CRISPR-associated endonuclease domain having nickase activity, in some embodiments, said CRISPR-associated endonuclease domain nicks the target site DNA strand containing the PAM site (e.g., and does not nick the target site DNA strand that does not contain the PAM site). As a further example, when a polypeptide comprises a CRISPR-associated endonuclease domain having nickase activity, in some embodiments, said CRISPR-associated endonuclease domain nicks the target site DNA strand not containing the PAM site (e.g., and does not nick the target site DNA strand that contains the PAM site).

In some other embodiments, the endonuclease domain has nickase activity that nicks the target site DNA of the first strand and the second strand. Without wishing to be bound by theory, after a writing domain (e.g., RT domain) of a polypeptide described herein polymerizes (e.g., reverse transcribes) from the heterologous object sequence of a template nucleic acid (e.g., template RNA), the cellular DNA repair machinery must repair the nick on the first DNA strand. The target site DNA now contains two different sequences for the first DNA strand: one corresponding to the original genomic DNA (e.g., having a free 5' end) and a second corresponding to that polymerized from the heterologous object sequence (e.g., having a free 3' end). It is thought that the two different sequences equilibrate with one another, first one hybridizing the second strand, then the other, and which sequence the cellular DNA repair apparatus incorporates into its repaired target site may be a stochastic process. Without wishing to be bound by theory, it is thought that introducing an additional nick to the second-strand may bias the cellular DNA repair machinery to adopt the heterologous object sequence-based sequence more frequently than the original genomic sequence (Anzalone et al. Nature 576:149-157 (2019)). In some embodiments, the additional nick is positioned at least 10, 15, 20, 25, 30, 35, 40, 45, 50, 55, 60, 65, 70, 75, 80, 85, 90, 95, 100, 105, 110, 115, 120, 125, 130, 135, 140, 145, or 150 nucleotides 5' or 3' of the target site modification (e.g., the insertion, deletion, or substitution) or to the nick on the first strand.

Alternatively, or additionally, without wishing to be bound by theory, it is thought that an additional nick to the second strand may promote second-strand synthesis. In some embodiments, where the gene modifying system has inserted or substituted a portion of the first strand, synthesis of a new sequence corresponding to the insertion/substitution in the second strand is necessary.

In some embodiments, the polypeptide comprises a single domain having endonuclease activity (e.g., a single endonuclease domain) and said domain nicks both the first strand and the second strand. For example, in such an embodiment the endonuclease domain may be a CRISPR-associated endonuclease domain, and the template nucleic acid (e.g., template RNA) comprises a gRNA spacer that directs nicking of the first strand and an additional gRNA spacer that directs nicking of the second strand. In some embodiments, the polypeptide comprises a plurality of domains having endonuclease activity, and a first endonuclease domain nicks the first strand and a second endonuclease domain nicks the second strand (optionally, the first endonuclease domain does not (e.g., cannot) nick the second strand and the second endonuclease domain does not (e.g., cannot) nick the first strand).

In some embodiments, the endonuclease domain is capable of nicking a first strand and a second strand. In some embodiments, the first and second strand nicks occur at the same position in the target site but on opposite strands. In some embodiments, the second strand nick occurs in a staggered location, e.g., upstream or downstream, from the first nick. In some embodiments, the endonuclease domain generates a target site deletion if the second strand nick is upstream of the first strand nick. In some embodiments, the endonuclease domain generates a target site duplication if the second strand nick is downstream of the first strand nick. In some embodiments, the endonuclease domain generates no duplication and/or deletion if the first and second strand nicks occur in the same position of the target site. In some embodiments, the endonuclease domain has altered activity depending on protein conformation or RNA-binding status, e.g., which promotes the nicking of the first or second strand (e.g., as described in Christensen et al. PNAS 2006; incorporated by reference herein in its entirety).

In some embodiments, the endonuclease domain comprises a meganuclease, or a functional fragment thereof. In some embodiments, the endonuclease domain comprises a homing endonuclease, or a functional fragment thereof. In some embodiments, the endonuclease domain comprises a meganuclease from the LAGLIDADG (SEQ ID NO: 15464), GIY-YIG, HNH, His-Cys Box, or PD-(D/E) XK families, or a functional fragment or variant thereof, e.g., which possess conserved amino acid motifs, e.g., as indicated in the family names. In some embodiments, the endonuclease domain comprises a meganuclease, or fragment thereof, chosen from, e.g., I-SmaMI (Uniprot F7WD42), I-SceI (Uniprot P03882), I-AniI (Uniprot P03880), I-DmoI (Uniprot P21505), I-CreI (Uniprot P05725), I-TevI (Uniprot P13299), I-OnuI (Uniprot Q4VWW5), or I-BmoI (Uniprot Q9ANR6). In some embodiments, the meganuclease is naturally monomeric, e.g., I-SceI, I-TevI, or dimeric, e.g., I-CreI, in its functional form. For example, the LAGLIDADG meganucleases ("LAGLIDADG" disclosed as SEQ ID NO: 15464) with a single copy of the LAGLIDADG motif (SEQ ID NO: 15464) generally form homodimers, whereas members with two copies of the LAGLIDADG motif (SEQ ID NO: 15464) are generally found as monomers. In some embodiments, a meganuclease that normally forms as a dimer is expressed as a fusion, e.g., the two subunits are expressed as a single ORF and, optionally, connected by a linker, e.g., an I-CreI dimer fusion (Rodriguez-Fornes et al. Gene Therapy 2020; incorporated by reference herein in its entirety). In some embodiments, a meganuclease, or a functional fragment thereof, is altered to favor nickase activity for one strand of a double-stranded DNA molecule, e.g., I-SceI (K1221 and/or K2231) (Niu et al. J Mol Biol 2008), I-AniI (K227M) (McConnell Smith et al. PNAS 2009), I-DmoI (Q42A and/or K120M) (Molina et al. J Biol Chem 2015). In some embodiments, a meganuclease or functional fragment thereof possessing this preference for single-strand cleavage is used as an endonuclease domain, e.g., with nickase activity. In some embodiments, an endonuclease domain comprises a meganuclease, or a functional fragment thereof, which naturally targets or is engineered to target a safe harbor site, e.g., an I-CreI targeting SH6 site (Rodriguez-Fornes et al., supra). In some embodiments, an endonuclease domain comprises a meganuclease, or a functional fragment thereof, with a sequence tolerant catalytic domain, e.g., I-TevI recognizing the minimal motif CNNNG (Kleinstiver et al. PNAS 2012). In some embodiments, a target sequence tolerant catalytic domain is fused to a DNA binding domain, e.g., to direct activity, e.g., by fusing I-TevI to: (i) zinc fingers to create Tev-ZFEs (Kleinstiver et al. PNAS 2012), (ii) other meganucleases to create MegaTevs (Wolfs et al. Nucleic Acids Res 2014), and/or (iii) Cas9 to create TevCas9 (Wolfs et al. PNAS 2016).

In some embodiments, the endonuclease domain comprises a restriction enzyme, e.g., a Type IIS or Type IIP restriction enzyme. In some embodiments, the endonuclease domain comprises a Type IIS restriction enzyme, e.g., FokI, or a fragment or variant thereof. In some embodiments, the endonuclease domain comprises a Type UP restriction enzyme, e.g., PvuII, or a fragment or variant thereof. In some embodiments, a dimeric restriction enzyme is expressed as a fusion such that it functions as a single chain, e.g., a FokI dimer fusion (Minczuk et al. Nucleic Acids Res 36(12):3926-3938 (2008)).

The use of additional endonuclease domains is described, for example, in Guha and Edgell Int J Mol Sci 18(22):2565 (2017), which is incorporated herein by reference in its entirety.

In some embodiments, a gene modifying polypeptide comprises a modification to an endonuclease domain, e.g., relative to a wild-type Cas protein. In some embodiments, the endonuclease domain comprises an addition, deletion, replacement, or modification to the amino acid sequence of the wild-type Cas protein. In some embodiments, the endonuclease domain is modified to include a heterologous functional domain that binds specifically to and/or induces endonuclease cleavage of a target nucleic acid (e.g., DNA) sequence of interest. In some embodiments, the endonuclease domain comprises a zinc finger. In embodiments, the endonuclease domain comprising the Cas domain is associated with a guide RNA (gRNA), e.g., as described herein. In some embodiments, the endonuclease domain is modified to include a functional domain that does not target a specific target nucleic acid (e.g., DNA) sequence. In embodiments, the endonuclease domain comprises a Fok1 domain.

In some embodiments, the endonuclease domain is associated with the target dsDNA in vitro at a frequency at least about 5-fold or 10-fold higher than with a scrambled dsDNA. In some embodiments, the endonuclease domain is associated with the target dsDNA in vitro at a frequency at least about 5-fold or 10-fold higher than with a scrambled dsDNA, e.g., in a cell (e.g., a HEK293T cell). In some embodiments, the frequency of association between the endonuclease domain and the target DNA or scrambled DNA is measured by ChIP-seq, e.g., as described in He and Pu (2010) Curr. Protoc Mol Biol Chapter 21 (incorporated by reference herein in its entirety).

In some embodiments, the endonuclease domain can catalyze the formation of a nick at a target sequence, e.g., to an increase of at least about 5-fold or 10-fold relative to a non-target sequence (e.g., relative to any other genomic sequence in the genome of the target cell). In some embodiments, the level of nick formation is determined using NickSeq, e.g., as described in Elacqua et al. (2019) bioRxiv doi.org/10.1101/867937 (incorporated herein by reference in its entirety).

In some embodiments, the endonuclease domain is capable of nicking DNA in vitro. In embodiments, the nick results in an exposed base. In embodiments, the exposed base can be detected using a nuclease sensitivity assay, e.g., as described in Chaudhry and Weinfeld (1995) Nucleic Acids Res 23(19):3805-3809 (incorporated by reference herein in its entirety). In embodiments, the level of exposed bases (e.g., detected by the nuclease sensitivity assay) is increased by at least 10%, 50%, or more relative to a reference endonuclease domain. In some embodiments, the reference endonuclease domain is an endonuclease domain from Cas9 of S. pyogenes.

In some embodiments, the endonuclease domain is capable of nicking DNA in a cell. In embodiments, the endonuclease domain is capable of nicking DNA in a HEK293T cell. In embodiments, an unrepaired nick that undergoes replication in the absence of Rad51 results in increased NHEJ rates at the site of the nick, which can be detected, e.g., by using a Rad51 inhibition assay, e.g., as described in Bothmer et al. (2017) Nat Commun 8:13905 (incorporated by reference herein in its entirety). In embodiments, NHEJ rates are increased above 0-5%. In embodiments, NHEJ rates are increased to 20-70% (e.g., between 30%-60% or 40-50%), e.g., upon Rad51 inhibition.

In some embodiments, the endonuclease domain releases the target after cleavage. In some embodiments, release of the target is indicated indirectly by assessing for multiple turnovers by the enzyme, e.g., as described in Yourik at al. RNA 25(1):35-44 (2019) (incorporated herein by reference in its entirety) and shown in FIG. 2. In some embodiments, the $k_{exp}$ of an endonuclease domain is $1\times10^{-3}$-$1\times10^{-5}$ min−1 as measured by such methods.

In some embodiments, the endonuclease domain has a catalytic efficiency ($k_{cat}/K_m$) greater than about $1\times10^8$ s$^{-1}$ M$^{-1}$ in vitro. In embodiments, the endonuclease domain has a catalytic efficiency greater than about $1\times10^5$, $1\times10^6$, $1\times10^7$, or $1\times10^8$, s$^{-1}$ M$^{-1}$ in vitro. In embodiments, catalytic efficiency is determined as described in Chen et al. (2018) Science 360(6387):436-439 (incorporated herein by reference in its entirety). In some embodiments, the endonuclease domain has a catalytic efficiency ($k_{cat}/K_m$) greater than about $1\times10$'s$^{-1}$ M$^{-1}$ in cells. In embodiments, the endonuclease domain has a catalytic efficiency greater than about $1\times10^5$, $1\times10^6$, $1\times10^7$, or $1\times10^8$ s$^{-1}$ M$^{-1}$ in cells.

Gene Modifying Polypeptides Comprising Cas Domains

In some embodiments, a gene modifying polypeptide described herein comprises a Cas domain. In some embodiments, the Cas domain can direct the gene modifying polypeptide to a target site specified by a gRNA spacer, thereby modifying a target nucleic acid sequence in "cis". In some embodiments, a gene modifying polypeptide is fused to a Cas domain. In some embodiments, a gene modifying polypeptide comprises a CRISPR/Cas domain (also referred to herein as a CRISPR-associated protein). In some embodiments, a CRISPR/Cas domain comprises a protein involved in the clustered regulatory interspaced short palindromic repeat (CRISPR) system, e.g., a Cas protein, and optionally binds a guide RNA, e.g., single guide RNA (sgRNA).

CRISPR systems are adaptive defense systems originally discovered in bacteria and archaea. CRISPR systems use RNA-guided nucleases termed CRISPR-associated or "Cas" endonucleases (e.g., Cas9 or Cpf1) to cleave foreign DNA. For example, in a typical CRISPR-Cas system, an endonuclease is directed to a target nucleotide sequence (e.g., a site in the genome that is to be sequence-edited) by sequence-specific, non-coding "guide RNAs" that target single- or double-stranded DNA sequences. Three classes (I-III) of CRISPR systems have been identified. The class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "spacer" sequence, a typically about 20-nucleotide RNA sequence that corresponds to a target DNA sequence ("protospacer"). In the wild-type system, and in some engineered systems, crRNA also contains a region that binds to the tracrRNA to form a partially double-stranded structure that is cleaved by RNase III, resulting in a crRNA/tracrRNA hybrid molecule. A crRNA/tracrRNA hybrid then directs the Cas endonuclease to recognize and cleave a target DNA sequence. A target DNA sequence is generally adjacent to a "protospacer adjacent motif" ("PAM") that is specific for a given Cas endonuclease and required for cleavage activity at a target site matching the spacer of the crRNA. CRISPR endonucleases identified from various prokaryotic species have unique PAM sequence requirements, e.g., as listed for exemplary Cas enzymes in Table 7; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), and 5'-NNNGATT (*Neisseria meningitidis*). Some endonucleases, e.g., Cas9 endonucleases, are associated with G-rich PAM sites, e. g., 5'-NGG, and perform blunt-end cleaving of the target DNA at a location 3 nucleotides upstream from (5' from) the PAM site. Another class II CRISPR system includes the type V endonuclease Cpf1, which is smaller than Cas9; examples include AsCpf1 (from *Acidaminococcus* sp.) and LbCpf1 (from *Lachnospiraceae* sp.). Cpf1-associated CRISPR arrays are processed into mature crRNAs without the requirement of a tracrRNA; in other words, a Cpf1 system, in some embodiments, comprises only Cpf1 nuclease and a crRNA to cleave a target DNA sequence. Cpf1 endonucleases, are typically associated with T-rich PAM sites, e.g., 5'-TTN. Cpf1 can also recognize a 5'-CTA PAM motif. Cpf1 typically cleaves a target DNA by introducing an offset or staggered double-strand break with a 4- or 5-nucleotide 5' overhang, for example, cleaving a target DNA with a 5-nucleotide offset or staggered cut located 18 nucleotides downstream from (3' from) a PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e.g., Zetsche et al. (2015) Cell, 163:759-771.

A variety of CRISPR associated (Cas) genes or proteins can be used in the technologies provided by the present disclosure and the choice of Cas protein will depend upon the particular conditions of the method. Specific examples of Cas proteins include class II systems including Cas1, Cas2, Cas3, Cas4, Cas5, Cas6, Cas7, Cas8, Cas9, Cas10, Cpf1, C2C1, or C2C3. In some embodiments, a Cas protein, e.g., a Cas9 protein, may be from any of a variety of prokaryotic species. In some embodiments a particular Cas protein, e.g., a particular Cas9 protein, is selected to recognize a particular protospacer-adjacent motif (PAM) sequence. In some embodiments, a DNA-binding domain or endonuclease domain includes a sequence targeting polypeptide, such as a Cas protein, e.g., Cas9. In certain embodiments a Cas protein, e.g., a Cas9 protein, may be obtained from a bacteria or archaea or synthesized using known methods. In certain embodiments, a Cas protein may be from a gram-positive bacteria or a gram-negative bacteria. In certain embodiments, a Cas protein may be from a *Streptococcus* (e.g., a *S. pyogenes*, or a *S. thermophilus*), a *Francisella* (e.g., an *F. novicida*), a *Staphylococcus* (e.g., an *S. aureus*), an *Acidaminococcus* (e.g., an *Acidaminococcus* sp. BV3L6), a *Neisseria* (e.g., an *N. meningitidis*), a *Cryptococcus*, a *Corynebacterium*, a *Haemophilus*, a *Eubacterium*, a *Pasteurella*, a *Prevotella*, a *Veillonella*, or a *Marinobacter*.

In some embodiments, a gene modifying polypeptide may comprise the amino acid sequence of SEQ ID NO: 4000 below, or a sequence having at least 70%, 75%, 80%, 85%, 90%, 95%, 96%, 97%, 98%, 99% identity thereto. In embodiments, the amino acid sequence of SEQ ID NO: 4000 below, or the sequence having at least 70%, 75%, 80%, 85%, 90%, 95%, 96%, 97%, 98%, 99% identity thereto, is positioned at the N-terminal end of the gene modifying polypeptide. In embodiments, the amino acid sequence of SEQ ID NO: 4000 below, or the sequence having at least 70%, 75%, 80%, 85%, 90%, 95%, 96%, 97%, 98%, 99% identity thereto, is positioned within 1, 2, 3, 4, 5, 6, 7, 8, 9, 10, 15, 20, 25, or 30 amino acids of the N-terminal end of the gene modifying polypeptide.

Exemplary N-Terminal NLS-Cas9 Domain (SEQ ID NO: 4000)

```
MPAAKRVKLDGGDKKYSIGLDIGTNSVGWAVITDEYKVPSKKFKVLGNTDRHSIKKNLIGALLF

DSGETAEATRLKRTARRRYTRRKNRICYLQEIFSNEMAKVDDSFFHRLEESFLVEEDKKHERHP

IFGNIVDEVAYHEKYPTIYHLRKKLVDSTDKADLRLIYLALAHMIKFRGHFLIEGDLNPDNSDV

DKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVN

TEITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKDNR

EKIEKILTFRIPYYVGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDLLFKTNRKVTVKQLK
```

-continued

```
EDYFKKIECFDSVEISGVEDRFNASLGTYHDLLKIIKDKDFLDNEENEDILEDIVLTLTLFEDR

EMIEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHKPE

NIVIEMARENQTTQKGQKNSRERMKRIEEGIKELGSQILKEHPVENTQLQNEKLYLYYLQNGRD

MYVDQELDINRLSDYDVDHIVPQSFLKDDSIDNKVLTRSDKARGKSDNVPSEEVVKKMKNYWRQ

LLNAKLITQRKFDNLTKAERGGLSELDKAGFIKRQLVETRQITKHVAQILDSRMNTKYDENDKL

IREVKVITLKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQHKHYLDEI

IEQISEFSKRVILADANLDKVLSAYNKHRDKPIREQAENIIHLFTLTNLGAPAAFKYFDTTIDR

KRYTSTKEVLDATLIHQSITGLYETRIDLSQLGGDGG
```

In some embodiments, a gene modifying polypeptide may comprise the amino acid sequence of SEQ ID NO: 4001 below, or a sequence having at least 70%, 75%, 80%, 85%, 90%, 95%, 96%, 97%, 98%, 99% identity thereto. In embodiments, the amino acid sequence of SEQ ID NO: 4001 below, or the sequence having at least 70%, 75%, 80%, 85%, 90%, 95%, 96%, 97%, 98%, 99% identity thereto, is positioned at the C-terminal end of the gene modifying polypeptide. In embodiments, the amino acid sequence of SEQ ID NO: 4001 below, or the sequence having at least 70%, 75%, 80%, 85%, 90%, 95%, 96%, 97%, 98%, 99% identity thereto, is positioned within 1, 2, 3, 4, 5, 6, 7, 8, 9, 10, 15, 20, 25, or 30 amino acids of the C-terminal end of the gene modifying polypeptide.

Exemplary C-Terminal Sequence Comprising an NLS

```
                                        (SEQ ID NO: 4001)
AGKRTADGSEFEKRTADGSEFESPKKKAKVE
```

Exemplary Benchmarking Sequence

```
                                        (SEQ ID NO: 4002)
MPAAKRVKLDGGDKKYSIGLDIGTNSVGWAVITDEYKVPSKKFKVLGNTDRHSIKKNLIGALLF

DSGETAEATRLKRTARRRYTRRKNRICYLQEIFSNEMAKVDDSFFHRLEESFLVEEDKKHERHP

IFGNIVDEVAYHEKYPTIYHLRKKLVDSTDKADLRLIYLALAHMIKFRGHFLIEGDLNPDNSDV

DKLFIQLVQTYNQLFEENPINASGVDAKAILSARLSKSRRLENLIAQLPGEKKNGLFGNLIALS

LGLTPNFKSNFDLAEDAKLQLSKDTYDDDLDNLLAQIGDQYADLFLAAKNLSDAILLSDILRVN

TEITKAPLSASMIKRYDEHHQDLTLLKALVRQQLPEKYKEIFFDQSKNGYAGYIDGGASQEEFY

KFIKPILEKMDGTEELLVKLNREDLLRKQRTFDNGSIPHQIHLGELHAILRRQEDFYPFLKDNR

EKIEKILTFRIPYYVGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTLFEDR

EMIEERLKTYAHLFDDKVMKQLKRRRYTGWGRLSRKLINGIRDKQSGKTILDFLKSDGFANRNF

MQLIHDDSLTFKEDIQKAQVSGQGDSLHEHIANLAGSPAIKKGILQTVKVVDELVKVMGRHKPE

NIVIEMARENQTTQKGQKNSRERMKRIEEGIKELGSQILKEHPVENTQLQNEKLYLYYLQNGRD

MYVDQELDINRLSDYDVDHIVPQSFLKDDSIDNKVLTRSDKARGKSDNVPSEEVVKKMKNYWRQ

LLNAKLITQRKFDNLTKAERGGLSELDKAGFIKRQLVETRQITKHVAQILDSRMNTKYDENDKL

IREVKVITLKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDPKKYGGFDSPTVAY

SVLVVAKVEKGKSKKLKSVKELLGITIMERSSFEKNPIDFLEAKGYKEVKKDLIIKLPKYSLFE
```

-continued

LENGRKRMLASAGELQKGNELALPSKYVNFLYLASHYEKLKGSPEDNEQKQLFVEQHKHYLDEI

IEQISEFSKRVILADANLDKVLSAYNKHRDKPIREQAENIIHLFTLTNLGAPAAFKYFDTTIDR

KRYTSTKEVLDATLIHQSITGLYETRIDLSQLGGDGGSGGSSGGSSGSETPGTSESATPESSGG

SSGGSSGGTLNIEDEYRLHETSKEPDVSLGSTWLSDFPQAWAETGGMGLAVRQAPLIIPLKATS

TPVSIKQYPMSQEARLGIKPHIQRLLDQGILVPCQSPWNTPLLPVKKPGTNDYRPVQDLREVNK

RVEDIHPTVPNPYNLLSGLPPSHQWYTVLDLKDAFFCLRLHPTSQPLFAFEWRDPEMGISGQLT

WTRLPQGFKNSPTLFNEALHRDLADFRIQHPDLILLQYVDDLLLAATSELDCQQGTRALLQTLG

NLGYRASAKKAQICQKQVKYLGYLLKEGQRWLTEARKETVMGQPTPKTPRQLREFLGKAGFCRL

FIPGFAEMAAPLYPLTKPGTLFNWGPDQQKAYQEIKQALLTAPALGLPDLTKPFELFVDEKQGY

AKGVLTQKLGPWRRPVAYLSKKLDPVAAGWPPCLRMVAAIAVLTKDAGKLTMGQPLVILAPHAV

EALVKQPPDRWLSNARMTHYQALLLDTDRVQFGPVVALNPATLLPLPEEGLQHNCLDILAEAHG

TRPDLTDQPLPDADHTWYTDGSSLLQEGQRKAGAAVTTETEVIWAKALPAGTSAQRAELIALTQ

ALKMAEGKKLNVYTDSRYAFATAHIHGEIYRRRGWLTSEGKEIKNKDEILALLKALFLPKRLSI

IHCPGHQKGHSAEARGNRMADQAARKAAITETPDTSTLLIENSSPSGGSKRTADGSEFEAGKRT

ADGSEFEKRTADGSEFESPKKKAKVE

In some embodiments, a gene modifying polypeptide may comprise a Cas domain as listed in Table 7 or 8, or a functional fragment thereof, or a sequence having at least 70%, 75%, 80%, 85%, 90%, 95%, 96%, 97%, 98%, 99% identity thereto.

TABLE 7

CRISPR/Cas Proteins, Species, and Mutations

| Name | Enzyme | Species | # of AAs | PAM | Mutations to alter PAM recognition | Mutations to make catalytically dead |
|---|---|---|---|---|---|---|
| FnCas9 | Cas9 | Francisella novicida | 1629 | 5'-NGG-3' | Wt | D11A/H969A/N995A |
| FnCas9 RHA | Cas9 | Francisella novicida | 1629 | 5'-YG-3' | E1369R/E1449H/R1556A | D11A/H969A/N995A |
| SaCas9 | Cas9 | Staphylococcus aureus | 1053 | 5'-NNGRRT-3' | Wt | D10A/H557A |
| SaCas9 KKH | Cas9 | Staphylococcus aureus | 1053 | 5'-NNNRRT-3' | E782K/N968K/R1015H | D10A/H557A |
| SpCas9 | Cas9 | Streptococcus pyogenes | 1368 | 5'-NGG-3' | Wt | D10A/D839A/H840A/N863A |
| SpCas9 VQR | Cas9 | Streptococcus pyogenes | 1368 | 5'-NGA-3' | D1135V/R1335Q/T1337R | D10A/D839A/H840A/N863A |
| AsCpf1 RR | Cpf1 | Acidaminococcus sp. BV3L6 | 1307 | 5'-TYCV-3' | S542R/K607R | E993A |
| AsCpf1 RVR | Cpf1 | Acidaminococcus sp. BV3L6 | 1307 | 5'-TATV-3' | S542R/K548V/N552R | E993A |
| FnCpf1 | Cpf1 | Francisella novicida | 1300 | 5'-NTTN-3' | Wt | D917A/E1006A/D1255A |
| NmCas9 | Cas9 | Neisseria meningitidis | 1082 | 5'-NNNGATT-3' | Wt | D16A/D587A/H588A/N611A |

TABLE 8

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| Nme2Cas9 | Neisseria meningitidis | MAAFKPNPINYILGLDIGIASVGWAMVEIDEEENPIRLIDLGVRVFERAEVPK TGDSLAMARRLARSVRRLITRRRAHRLLRARRLLKREGVLQAADFDENGLIKS LPNTPWQLRAAALDRKLTPLEWSAVLLHLIKHRGYLSQRKNEGETADKELG ALLKGVANNAHALQTGDFRTPAELALNKFEKESGHIRNQRGDYSHTFSRKD LQAELILLFEKQKEFGNPHVSGGLKEGIETLLMTQRPALSGDAVQKMLGHCT FEPAEPKAAKNTYTAERFIWLTKLNNLRILEQGSERPLTDTERATLMDEPYRK SKLITYAQARKLLGLEDTAFFKGLRYGKDNAEASTLMEMKAYHAISRALEKEG LKDKKSPLNLSSELQDEIGTAFSLFKTDEDITGRLKDRVQPEILEALLKHISFDKF VQISLKALRRIVPLMEQGKRYDEACAEIYGDHYGKKNTEEKIYLPPIPADEIRN PVVLRALSQARKVINGVVRRYGSPARIHIETAREVGKSFKDRKEIEKRQBENR KDREKAAAKFREYFPNFVGEPKSKDILKLRLYEQOHGKCLYSGKEINLVRLNE KGYVEIDHALPFSRTWDDSFNNKVIVLGSENQNKGNQTPYEYFNGKDNSR EWQEFKARVETSRFPPRSKKQRILLQKFDEDEGFKECNLNDTRYVNRFLCQFVA DHILLTGKGKRRVFASNGQITNLLRGFWGLRKVRAENDRHHALDAVVVACS TVAMQQKITRFVRYKEMNAFDGKTIDKETGKVLHQKTHFPQPWEFFAQEV MIRVFGKPDGKPEFBEADTPEKLRTLLAEKLSSRPEAVHEYVTPLFVSRAPNR KMSGAHKDTLRSAKRFVKHNEKISVKRVWLTEIKLADLENMVNYKNGREIEL YEALKARLEAYGGNAKQAFDPKDNPFYKKGGQLVKAVRVEKTQESGVLLNK KNAYTIADNGDMVRVDVFCKVDKKGKNQYFIVPIYAWQVAENILPDIDCKG YRIDDSYTFCFSLHKYDLIAFQKDEKSKVEFAYYINCDSSNGRFYLAWHDKGS KEQQFRISTQNLVLIQKYQVNELGKEIRPCRLKKRPPVR | 9,001 | N611A | H588A | D16A |
| PpnCas9 | Pasteurella pneumotropica | MQNNPLNYILGLDLGIASIGWAVVEIDEESSPIRLIDVGVRTFERAEVAKTGE SLALSRRLARSSRRLIKRRAERLKKAKRLLKAEKILHSIDEKLPINVWQLRVKGL KEKLERQEWAAVLLHLSKHRGYLSQRKNEGKSDNKELGALLSGIASNHQML QSSEYRTPAFIAVKKFQVEEGHIRNQRGSYTHTFSRLDLLAEMELLFQRQAEL GNSYTSTTLLENLITALLMWQKPALAGDAILKMLGKCTFEPSEYKAAKNSYSA ERFVWLTKLNNLRILENGTERALNDNERFALLEQPYEKSKLTYAQVRAMLAL SDNAIFKGVRYLGEDKKTVESKTTLIEMKFYHQIRKTLGSAELKKEWNELKGN SDLLDEIGTAFSLYKTDDDICRYLEGKLPERVLNALLENLNFDKFIQLSLKALHQ ILPLMLQGQRYDEAVSAIYGDHYGKKSTETTRLLPTIPADEIRNPVVLRTLTQA RKVINAVVRLYGSPARIHIETAREVGKSYQDRKKLEKQQEDNRKQRESAVKK FKEMPPHFVGEPKGKDILKMRLYELQQAKCLYSGKSLELHRLLEKGYVEVDH ALPFSRTWDDSFNNKVLVLANENQNKGNLTPYEWLDGKNNSERMQHFVV RVQTSGFSYAKKQRILNHKLDEKGFIERNLNDTRYVARFICNFIADNMLLVG KGKRNVFASNGQITALLRHRWGLQKVREQNDRHHALDAVVVACSTVAMQ QKITRFVRYNEGNVFSGERIDRETGEIIPLHFPSPWAFFKENVEIRIFSENPKLE LENRLPDYPQYNHEWVQPLFVSRMPTRKMTGQGHMETVKSAKRLNEGLS VLKVPLTQLKLSDLERMVNRDREIALYESLKARLEQFGNDPAKAFAEPFYKKG GALVKAVRLEQTQKSGVLVRDGNGVADNASMVRVDVFTKGGKYFLVPIYT WQVAKGILPNRAATQGKDENDWDIMDEMATFQFSLCQNDLIKLVTKKKTI FGYFNGLNRATSNINIKEHDLDKSKGKLGIYLEVGVKLAISLEKYQVDELGKNI RPCRPTKRQHVR | 9,002 | N605A | H582A | D13A |
| SauCas9 | Staphylococcus aureus | MKRNYILGLDIGITSVGYGIIDYETRDVIDAGVRLFKEANVENNEGRRSKRGA RRLKRRRRHRIQRVKKLLFDYNLLTDHSELSGINPYEARVKGLSQKLSEEEFSA | 9,003 | N580A | H557A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | ALLHLAKRRGVHNVEEDTGNELSTKEQISRNSKALEKYVAELQLERLKK DGEVRGSINRFKTSDYVKEAKQLLKVQKAYHQLDQSFIDTYIDLLETRRTYYE GPGEGSPFGWKDIKEWYEMLMGHCTYFPEELRSVKYAYNADLYNALNDLN NLVITRDENEKLEYYEKFQIIENVFKQKKKPTLKQIAKEILVNEEDIKGYRVTST GKPEFTNLKVYHDIKDITARKEIIENAELLDQIAKILTIYQSSEDIQEELTNLNSE LTQEEIEQISNLKGYTGTHNLSLKAINLIIDELWHTNDNQIAIFNRLKLVPKKV DLSQQKEIPTTLVDDFILSPVVKRSFIQSIKVINAIIKKYGLPNDIIIELAREKNSK DAQKMINEMQKRNRQTNERIEEIIRTTGKENAKYLIEKIKLHDMQEGKCLYS LEAIPLEDLLNNPFNYEVDHIIPRSVSFDNSFNNKVLVKQEENSKKGNRTPFQ YLSSSDSKISYETFKKHILNLAKGKGRISKTKKEYLLEERDINRFSVQKDFINRNL VDTRYATRGLMNLLRSYFRVNNLDVKVKSINGGFTSFLRRKWKFKKERNKG YKHHAEDALIIANADFIFKEWKKLDKAKKVMENQMFEEKQAESMPEIETEQ EYKEIFITPHQIKHIKDFKDYKYSHRVDKKPNRELINDTLYSTRKDDKGNTLIVN NLNGLYDKDNDKLKKLINKSPEKLLMYHHDPQTYQKLKLIMEQYGDEKNPL YKYYEETGNVLTKYSKKDNGPVIKKIKYYGNKLNAHLDITDDYPNSRNKVVKL SLKPYRFDVYLDNGVYKFVTVKNLDVIKKENYYEVNSKCYEBAKKLKKISNQA EFIASFYNNDLIKINGELYRVIGVNNDLLNRIEVNMIDITYREYLENMNDKRPP RIIKTIASKTQSIKKYSTDILGNLYEVKSKKHPQIIKKG | | | | |
| SauCas9-KKH | Staphylococcus aureus | MKRNYILGLDIGITSVGYGIIDYETRDVIDAGVRLFKEANVENNEGRRSKRGA RRLKRRRHRIQRVKKLLFDYNLLTDHSELSGINPYEARVKGLSQKLSEEFSA ALLHLAKRRGVHNVEEDTGNELSTKEQISRNSKALEKYVAELQLERLKK DGEVRGSINRFKTSDYVKEAKQLLKVQKAYHQLDQSFIDTYIDLLETRRTYYE GPGEGSPFGWKDIKEWYEMLMGHCTYFPEELRSVKYAYNADLYNALNDLN NLVITRDENEKLEYYEKFQIIENVFKQKKKPTLKQIAKEILVNEEDIKGYRVTST GKPEFTNLKVYHDIKDITARKEIIENAELLDQIAKILTIYQSSEDIQEELTNLNSE LTQEEIEQISNLKGYTGTHNLSLKAINLIIDELWHTNDNQIAIFNRLKLVPKKV DLSQQKEIPTTLVDDFILSPVVKRSFIQSIKVINAIIKKYGLPNDIIIELAREKNSK DAQKMINEMQKRNRQTNERIEEIIRTTGKENAKYLIEKIKLHDMQEGKCLYS LEAIPLEDLLNNPFNYEVDHIIPRSVSFDNSFNNKVLVKQEENSKKGNRTPFQ YLSSSDSKISYETFKKHILNLAKGKGRISKTKKEYLLEERDINRFSVQKDFINRNL VDTRYATRGLMNLLRSYFRVNNLDVKVKSINGGFTSFLRRKWKFKKERNKG YKHHAEDALIIANADFIFKEWKKLDKAKKVMENQMFEEKQAESMPEIETEQ EYKEIFITPHQIKHIKDFKDYKYSHRVDKKPNRKLINDTLYSTRKDDKGNTLIV NNLNGLYDKNDKLKKLINKSPEKLLMYHHDPQTYQKLKLIMEQYGDEKNP LYKYYEETGNVLTKYSKKDNGPVIKKIKYYGNKLNAHLDITDDYPNSRNKVVK LSLKPYRFDVYLDNGVYKFVTVKNLDVIKKENYYEVNSKCYEEAKKLKKISNQ AEFIASFYKNDLIKINGELYRVIGVNNDLLNRIEVNMIDITYREYLENMNDKRP PHIIKTIASKTQSIKKYSTDILGNLYEVKSKKHPQIIKKG | 9,004 | N580A | H557A | D10A |
| SauriCas9 | Staphylococcus auricularis | MQENQQKQNYILGLDIGITSVGYGLIDSKTREVIDAGVRLFPEADSENNSNR RSKRGARRLKRRIHRLNRVKDLLADYQMIDLNNVPKSTDPYTIRVKGLREPL TKEEFAIALLHIAKRRGLHNISVSMGDEEQDNELSTKQQLQKNAQQLQDKY VCELQLERLTNINKVRGEKNRFKTEDFVKEVKQLCETQRQYHNIDDQFIQQY IDLVSTRREYFEGPGNGSPYGWDGDLLKWYEKLMGRCTYFPEELRSVKYAYS ADLFNALNDLNNLVVTRDDNPKLEYYEKYHIIENVFKQKKNPTLKQIAKEIGV QDYDIRGYRITKSGKPQFTSFKLYHDLKNIFEQAKYLEDVEMLDEIAKILTIYQ DEISIKKALDQLPELLTESEKSQIAQLTGTGTHRLSLKCIHIVIDELWESPENQ | 9,005 | N588A | H565A | D15A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | MEIFTRLNLKPKKVEMSEIDSIPTTLVDEFILSPVVKRAFIQSIKVINAVINRFGL PEDIIIELAREKNSKDRRKFINKLQKQNEATRKKIEQLLAKYGNTNAKYMIEKI KLHDMQEGKCLYSLEAIPLEDLLSNPTHYEVDHIIPRSVSFDNSLNNKVLVKQ SENSKKGNRTPYQYLSSNESKISYNQFKQHILNLSKADRISKKRDMLLEER DINKFEVQKEFINRNLVDTRYATRELSNLLKTYFSTHDYAVKVKTINGGFTNH LRKVWDFKKHRNGHYKHHAEDALVIANADFLFKTHKALRRTDKILEQPGLE VNDTTVKVDTEEKYQELFETPKQVKNIKQPRDFKYSHRVDKKPNRQLINDTL YSTREIDGETYVVQTLKDLYAKDNEKVKKLFTERPQKILMYQHDPKTFEKLM TILNQYAEAKNPLAAYYEDKGEYVTKYAKKGNGPAIHKIKYIDKKLGSVLDVS NKYPETQNKLVKLSLKSFRPDIYKCEQGYKMVSIGYLDVLKKDNYYYIPKDKYE AEKQKKKIKESDLFVGSFYYNDLIMYEDELFRVIGVNSDINNLVELNMVDITY KDFCEVNNVTGEKRIKKTIGKRVVLIEKYTTDILGNLYKTPLPKKPQLIFKRGEL | | | | |
| SauriCas9-KKH | Staphylococcus auricularis | MQENQQKQNYILGLDIGITSVGYGLIDSKTREVIDAGVRLFPEADSENNSNR RSKRGARRLKRRIHRLNRVKDLLADYQMIDLNNVPKSTDPYTIRVKGLREPL TKEEFAIALLHIAKRGLHNISVSMGDEEQDNELSTKQQLQKNAQQLQDKY VCELQLERLTNINKVRGEKNRFKTEDFVKEVKQLCETQRQYHNIDDQFIQQY IDLVSTRREYFEGPGNGSPYGWDGDLLKWVEKLMGRCTYFPEELRSVKYAYS ADLFNALNDLNNLVVTRDDNPKLEYYEKYHIIENVFKQKNPTLKQIAKEIGV QDYDIRGYRITKSGKPQFTSFKLYHDLKNIFEQAKYLEDVEMLDEIAKILTIYQ DEISIKKALDQLPELLTESEKSQIAQLTGYTGTHRLSLKCCIHIVIDELWESPENQ MEIFTRLNLKPKKVEMSEIDSIPTTLVDEFILSPVVKRAFIQSIKVINAVINRFGL PEDIIIELAREKNSKDRRKFINKLQKQNEATRKKIEQLLAKYGNTNAKYMIEKI KLHDMQEGKCLYSLEAIPLEDLLSNPTHYEVDHIIPRSVSFDNSLNNKVLVKQ SENSKKGNRTPYQYLSSNESKISYNQFKQHILNLSKADRISKKRDMLLEER DINKFEVQKEFINRNLVDTRYATRELSNLLKTYFSTHDYAVKVKTINGGFTNH LRKVWDFKKHRNGHYKHHAEDALVIANADFLFKTHKALRRTDKILEQPGLE VNDTTVKVDTEEKYQELFETPKQVKNIKQPRDFKYSHRVDKKPNRKLINDTL YSTREIDGETYVVQTLKDLYAKDNEKVKKLFTERPQKILMYQHDPKTFEKLM TILNQYAEAKNPLAAYYEDKGEYVTKYAKKGNGPAIHKIKYIDKKLGSVLDVS NKYPETQNKLVKLSLKSFRPDIYKCEQGYKMVSIGYLDVLKKDNYYYIPKDKYE AEKQKKKIKESDLFVGSFYKNDLIMYEDELFRVIGVNSDINNLVELNMVDITY KDFCEVNNVTGEKHIKKTIGKRVVLIEKYTTDILGNLYKTPLPKKPQLIFKRGEL | 9,006 | N583A | H565A | D15A |
| ScaCas9-Sc++ | Streptococcus canis | MEKKYSIGLDIGTNSVGWAVITDDYKVPSKKFKVLGNTNRKSIKKNLMGALL FDSGETAEATRLKRTARRRYTRRKNRIRYLQEIFANEMAKLDDSFFQRLEESF LVEEDKKNERHPIFGNLADEVAYHRNYPTIYHLRKKLADSPEKADLRLIYLALA HIIKFRGHFLIEGKLNAENSDVAKLFYQLIQTYNQLFEESPLDEIEVDAKGILSA RLSKSKRLEKLIAVFPNEKKNGLFGNIIALALGLTPNFKSNFDLTEDAKLQLSKD TYDDLDELLGQIGDQYADLFSAAKNLSDAILLSDILRSNSEVTKAPLSASMV KRYDEHHQDLALLKTLVRQQFPEKYAEIFKDDTKNGYAGYVGADKKLRKRS GKLATEEEFYKFIKPILEKMDGAEELLAKLNRDDLLRKQRTFDNGSIPHQIHLK ELHAILRRQEFYPPLKENREKIEKILTFRIPYYVGPLARGNSRFAWLTRKSEEA ITPWNFEEVVDKGASAQSFIERMTNFDEQLPNKKVLPKHSLLYEYFTVYNEL TKVKYVTERMRKPEFLSGEQKKAIVDLLFKTNRKVTVKQLKEDYFKKIECFDS VEIIGVEDRFNASLGTYHDLLKIIKDKDFLDNEENEDILEDIVLTLTLFEDREMIE ERLKTYAHLFDDKVMKQLKRRHYTGWGRLSRKMINGIRDKQSGKTILDFLKS DGFSNRNFMQLIHDDSLTFKEEIEKAQVSGQGDSLHEQIADLAGSPAIKKGIL | 9,007 | N872A | H849A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | QTVKIVDELVKVMGHKPENIVIEMARENQTTKGLQQSRERKKRIEEGIKELE SQILKENPVENTQLQNEKLYLYYLQNGRDMYVDQELDINRLSDYDVDHIVP QSFIKDDSIDNKVLTRSVENRGKSDNVPSEEVVKKMKNYWRQLLNAKLITQ RKFDNLTKAERGGLSEADKAGFIKRQLVETRQITKHVARILDSRMNTKRDKN DKPIREVKVITLKSKLVSDFRKDFQLYKVRDINNYHHAHDAYLNAVVGTALIK KYPKLESEFVYGDYKVYDVRKMIAKSEQEIGKATAKRFFYSNIMNFFKTEVKL ANGEIRKRPLIETNGETGEVVWNKEKDFATVRKVLAMPQVNIVKKTEVQTG GFSKESILSKRESAKLIPRKKGWDTRKYGGFGSPTVAYSILVVAKVEKGKAKKL KSVKVLVGITIMEKGSYEKDPIGFLEAKGYKDIKKELIFKLPKYSLFELENGRRR MLASAKELQKANELVLPQHVLRLLYYTQNISATTGSNNLGYIEQHREEPKEIF EKIIDFSEKYILKNKVNSNLKSSFDEQFAVSDSILLSNSFVSLLKYTSFGASGGFT FLDLDVKQGRLRYQTVTEVLDATLIYQSITGLYETRTDLSQLGGD | | | | |
| SpyCas9 | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEBELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEIANLAGSPAIKKGILQTVKV VDELVKVMGRHKPENIVIEMARENQTTQKGQKNSRERMKRIEEGIKELGSQ ILKEHPVENTQLQNEKLYLYYLQNGRDMVVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFDSPTVAYSVLVVAKVEKGKSKKLKSVKE LLGITIMERSSFEKNPIDFLEAKGYKEVKKDLIIKLPKYSLFELENGRKRMLASA GELQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAF KYFDTTIDRKRYTSTKEVLDATLIHQSITGLYETRIDLSQLGGD | 9,008 | N863A | H840A | D10A |
| SpyCas9-NG | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEBELLVKLNREDLLRKQRTFDNGSIPHQIHLGELHAILRRQ | 9,009 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYYLQNGRDMVDQELDINRLSDYDVDHIVPQSF LKDDSIDNKVLTRSDKNRGKSDNVPSEEVVKKMKNYWRQLLNAKLITQRKF DNLTKAERGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES IRPKRNSDKLIARKKDWDPKKYGGFVSPTVAYSVLVVAKVEKGKSKKLSVKE LLGITIMERSSFEKNPIDFLEAKGYKEVKKDLIIKLPKYSLFELENGRKRMLASA RFLQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPRAF KYFDTTIDRKVYRSTKEVLDATLIHQSITGLYETRIDLSQLGGD | | | | |
| SpyCas9-SpRY | Streptococcus pyogenes | MDKKYSIGLDIGTNSVGWAVITDEYKVPSKKFKVLGNTDRHSIKKNLIGALLF DSGETAERTRLKRTARRRYTRRKNRICYLQEIFSNEMAKVDDSFFHRLEESFL VEEDKKHERHPIFGNIVDEVAYHEKYPTIYHLRKKLVDSTDKADLRLILYLALAH MIKFRGHFLIEGDLNPDNSDVDKLFIQLVQTYNQLFEENPINASGVDAKAILS ARLSKSRRLENLIAQLPGEKKNGLFGNLILALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYYLQNGRDMVDQELDINRLSDYDVDHIVPQSF LKDDSIDNKVLTRSDKNRGKSDNVPSEEVVKKMKNYWRQLLNAKLITQRKF DNLTKAERGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES IRPKRNSDKLIARKKDWDPKKYGGFLWPTVAYSVLVVAKVEKGKSKKLSVK ELLGITIMERSSFEKNPIDFLEAKGYKEVKKDLIIKLPKYSLFELENGRKRMLAS AKQLQKGNELALPSKYVNFLYLASHYEKLKGSPEDNEQKQLFVEQHKHYLDE IIEQISEFSKRVILADANLDKVLSAYNKHRDKPIREQAENIIHLFTLTRLGAPRAF KYFDTTIDPKQYRSTKEVLDATLIHQSITGLYETRIDLSQLGGD | 9,010 | N863A | H840A | D10A |
| St1Cas9 | Streptococcus thermophilus | MSDLVLGLDIGIGSVGVGILNKVTGEIIHKNSRIFPAAQAENNLVRRTNRQG RRLARRKKHRRVRLNRLFEESGLITDFTKISINLNPYQLRVKGLTDELSNEELFI | 9,011 | N622A | H599A | D9A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | ALKNMVKHRGISYLDDASDDGNSSVGDYAQIVKENSKQLETKTPGQIQLER YQTYGQLRGDFTVEKDGKKHRLINVFPTSAYRSEALRILQTQQEENPQITDEF INRYLEILITGKRKYYHGPGNEKSRTDYGRYRTSGETLDNIFGILIGKCTFYPDEF RAAKASYTAQEFNLLNDLNNLTVPTETKKLSKEQKNQIINYVKNEKAMGPAK LFKYIAKLLSCDVADIKGYRIDKSGKAEIHTFEAYRKMTLETLDIEQMDRETL DKLAYVLTLNTEREGIQEALEHEFADGSFSQKQVDELVQPRKANSSIFGKGW HNFSVKLMMELIPELYETSEEQMTILTRLGKQKTTSSSNKTKYIDEKLLTEEIY NPVVAKSVRQAIKIVNAAIKEYGDFDNIVIEMARETNEDDEKKAIQKIOKAN KDEKDAAMLKAANQYNGKAELPHSVFHGHKQLATKIRLMHQQGERCLYT GKTISIHDLINNSNQFEVDHILPLSITFDDSLANKVLVYATANQEKGQRTPYQ ALDSMDDAWSFRELKAFVRESKTLSNKKEYLLTEEDISKFDVRKKFIERNLV DTRYASRVVLNALQEHFRAHKIDTKVSVVRGQFTSQLRRHWGIREKTRDTYH HHAVDALIIAASSQLNLWKKQKNTLVSYSEDQLLDIETGELISDDEYKESVFK APYQHFVDTLKSKEFEDSLLFSYQVDSKFNRKISDATIYATRQAKVGKDKADE TYVLGKIDIYTQDGYDAFMKIYKKDKSKFLMYRHDPQTPEKVIEPILENYPN KQINEKGKVPCNPFLKYKEEHGYIRKYSKKGNGPEIKSLKYDSKLGNHIDIT PKDSNNKVVLQSVSPWRADVYFNKTTGKYEILGLKYADLQFEKGTGTYKISQ EKYNDIKKKEGVDSEFKFTLYKNDLLLVKDTETKEQQLFRFLSRTMPKQKH YVELKPYDKQKFEGEGALIKVLGNVANSGQCKKGLGKSNISIYKVRTDVLGN QHIIKNEGDKPKLDF | | | | |
| BlatCas9 | Brevibacillus laterosporus | MAYTMGIDVGIASCGWAIVDLERQRIIDIGVRTFEKAENPKNGEALAVPRRE ARSSRRLRRKKHRIERLKHMFVRNGLAVDIQHLEQTLRSQNEIDVWQLRV DGLDRMLTQKEWLRVLIHLAQRRGFQSNRKTDGSSEDGQVLVNVTENDRL MEEKDYRTVAEMMVKDEKFSDHKNKNGNYHGVVSRSSLLVEIHTLFETQ RQHNSLASKDFELEYVNIWSAQRPVATKDQIERMIGTCTFLPKEKRAPKAS WHFQYFMLQTINHIRITNVQGTRSLNKEIEQVVNMALTKSKVSYHDTRKI LDLSEEYQFVGLDYGKEDKKKVESKETIIKLDDYHKLNKIFNEVELAKGETWE ADDYDTVAYALTFFKDDEDIRDYLQNKYKDSKNRLVKNLANKEYTNELIGKV STLSFRKVGHLSLKALRKIIPFLEQGMTYDKACQAAGFDFQGISKKKRSVVLP VIDQISNPVVNRALTQTRKVINALIKKYGSPETIHIETARELSKTFDERKNITKD YKENRDKNEHAKKHLSELGIINPTGLDIVKYKLMCEQQGRCMYSNQPISFER LKESGYTEVDHIIPYSRSMNDSYNNRVLVMTRENREKGNQTPFEYMGNDT QRWYEFEQRVTTNPQIKKEKRQNLLLKGFTNRRELEMLERNLNDTRYIITKYL SHFISTNLERSPSDKKKVVNTSGRITSNHLRSRWGLEKNRGQNDLHHAMDAI VIAVTSDSFIQQVTNYYKRKERRELNGDDKFPLPWKFFREEVIARLSPNPKEQ IEALPNHFYSEDELADLQPIFVSRMPKRSITGEAHQAQFRRVVGKTKEGKNIT AKKTALVDISYDKNGDFNMYGRETDPATYEAIKERYLEFGGNVKKAFSTDLH KPKKDGTKGPLIKSVRIMENKTLVHPVNKGKGVVYNSSIVRTDVFQRKEKYY LLPVVTDVTKGKLPNKVIVAKKGYHDMIEVDDSFTFLFSLYPNDLIFIRQNPK KKISLKKRIESHSISDSKEVQEIHAYYKGVDSSTAAIEFIIHDGSYYAKGVGVQN LDCFEKYQVDILGNYFKVKGEKRLELETSDSNHKGKDVNSIKSTSR | 9,012 | N607A | H584A | D8A |
| cCas9-v16 | Staphylococcus aureus | MKRNVILGLDIGITSVGYGIIDYETRDVIDAGVRLFKEANVENNEGRRSKRGA RRLKRRRHRIQRVKKLLFDYNLLTDHSELSGINPYEARVKGLSQKLSEEFSA ALLHLAKRRGVHNVNEVEEDTGNELSTKEQISRNSKALEEKYVAELQLERLKK DGEVRGSINRFKTSDYVKEAKQLLKVQKAVHQLDQSFIDTYIDLLETRRTYYE GPGEGSPFGWKDIKEWYEMLMGHCTYFPEELRSVKYAYNADLYNALNDLN | 9,013 | N580A | H557A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | NLVITRDENEKLEYYEKFQIIENVFKQKKPTLKQIAKEILVNEEDIKGYRVTST GKPEFTNLKVYHDIKDITARKEIIENAELLDQJAKILTIYQSSEDIQEELTNLNSE LTQEEIEQISNLKGYTGTHNLSLKAINLILDELWHTNDNQIAIFNRLKLVPKKV DLSQQKEIPTTLVDDFILSPVVKRSFIQSIKVINAIIKKYGLPNDIIIELAREKNSK DAQKMINEMQKRNRQTNERIEEIIRTTGKENAKYLIEKIKLHDMQEGKCLYS LEAIPLEDLLNNPFNYEVDHIIPRSVSFDNSFNNKVLVKQEENSKKGNRTPFQ YLSSSDSKISYETFKKHILNLAKGKGRISKTKKEYLLEERDINRPSVQKDFINRNL VDTRYATRGLMNLLRSYFRVNNLDVKVKSINGGFTSFLRRKWKFKKERNKG YKHHAEDALLIANADFIFKEWKKLLDKAKKVMENQMFEEKQAESMPEIETEQ EYKEIFITPHQIHKHIKDFKDYKYSHRVDKKPNRKLINDTLYSTRKDDKGNTLIV NNLNGLYDKDNDKLKKLINKSPEKLLMYHHDPQTYQKLKLIMEQYGDEKNP LYKYEETGNYLTKYSKKDNGPVIKKIKYYGNKLNAHLDITDDYPNSRNKVVK LSLKPYRFDVYLDNGVYKFVTVKNLDVIKKENYYEVNSKCYEEAKKLKKISNQ AEFIASFYKNDLIKINGELYRVIGVNSDKKNLIEVNMIDITYREYLENMNDKRP PHIIKTIASKTQSIKKYSTDILGNLYEVKSKKHPQIIKKG | | | | |
| cCas9-v17 | Staphylococcus aureus | MKRNYILGLDIGITSVGYGIIDYETRDVIDAGVRLFKEANVENNEGRRSKRGA RRLKRRRHRIQRVKKLLFDYNLLTDHSELSGINPYEARVKGLSQKLSEEEFSA ALLHLAKRRGVHNVNEVEEDTGNELuSTKEQISRNSKALEEKYVAELQLERLKK DGEVRGSINRFKTSDYVKEAKQLLKVQKAYHQLDQSFIDTYIDLLETRRTYYE GPGEGSPFGWKDIKEWYEMLMGHCTYFPEELRSVKYAYNADLYNALNDLN NLVITRDENEKLEYYEKFQIIENVFKQKKPTLKQIAKEILVNEEDIKGYRVTST GKPEFTNLKVYHDIKDITARKEIIENAELLDQJAKILTIYQSSEDIQEELTNLNSE LTQEEIEQISNLKGYTGTHNLSLKAINLILDELWHTNDNQIAIFNRLKLVPKKV DLSQQKEIPTTLVDDFILSPVVKRSFIQSIKVINAIIKKYGLPNDIIIELAREKNSK DAQKMINEMQKRNRQTNERIEEIIRTTGKENAKYLIEKIKLHDMQEGKCLYS LEAIPLEDLLNNPFNYEVDHIIPRSVSFDNSFNNKVLVKQEENSKKGNRTPFQ YLSSSDSKISYETFKKHILNLAKGKGRISKTKKEYLLEERDINRPSVQKDFINRNL VDTRYATRGLMNLLRSYFRVNNLDVKVKSINGGFTSFLRRKWKFKKERNKG YKHHAEDALLIANADFIFKEWKKLLDKAKKVMENQMFEEKQAESMPEIETEQ EYKEIFITPHQIHKHIKDFKDYKYSHRVDKKPNRKLINDTLYSTRKDDKGNTLIV NNLNGLYDKDNDKLKKLINKSPEKLLMYHHDPQTYQKLKLIMEQYGDEKNP LYKYEETGNYLTKYSKKDNGPVIKKIKYYGNKLNAHLDITDDYPNSRNKVVK LSLKPYRFDVYLDNGVYKFVTVKNLDVIKKENYYEVNSKCYEEAKKLKKISNQ AEFIASFYKNDLIKINGELYRVIGVNNSTRNIVELNMIDITYREYLENMNDKRP PHIIKTIASKTQSIKKYSTDILGNLYEVKSKKHPQIIKKG | 9,014 | N580A | H557A | D10A |
| cCas9-v21 | Staphylococcus aureus | MKRNYILGLDIGITSVGYGIIDYETRDVIDAGVRLFKEANVENNEGRRSKRGA RRLKRRRHRIQRVKKLLFDYNLLTDHSELSGINPYEARVKGLSQKLSEEEFSA ALLHLAKRRGVHNVNEVEEDTGNELuSTKEQISRNSKALEEKYVAELQLERLKK DGEVRGSINRFKTSDYVKEAKQLLKVQKAYHQLDQSFIDTYIDLLETRRTYYE GPGEGSPFGWKDIKEWYEMLMGHCTYFPEELRSVKYAYNADLYNALNDLN NLVITRDENEKLEYYEKFQIIENVFKQKKPTLKQIAKEILVNEEDIKGYRVTST GKPEFTNLKVYHDIKDITARKEIIENAELLDQJAKILTIYQSSEDIQEELTNLNSE LTQEEIEQISNLKGYTGTHNLSLKAINLILDELWHTNDNQIAIFNRLKLVPKKV DLSQQKEIPTTLVDDFILSPVVKRSFIQSIKVINAIIKKYGLPNDIIIELAREKNSK DAQKMINEMQKRNRQTNERIEEIIRTTGKENAKYLIEKIKLHDMQEGKCLYS LEAIPLEDLLNNPFNYEVDHIIPRSVSFDNSFNNKVLVKQEENSKKGNRTPFQ | 9,015 | N580A | H557A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | YLSSSDSKISYETFKKHILNLAKGKRISKTKKEYLLEERDINRFSVQKDFINRNL VDTRYATRGLMNLLRSYFRVNNLDVKVKSINGGFTSFLRRKWKFKKERNKG YKHHAEDALIIANADFIFKEWKKLDKAKKVMENQMFEEKQAESMPEIETEQ EYKEIFITPHQIKHIKDFKDYKYSHRVDKKPNRKLINDTLYSTRKDDKGNTLIV NNLNGLYDKNDKLKKLINKSPEKLLMYHHDPQTYQKLLIMEQYGDEKNP LYKYEETGNYLTKYSKKDNGPVIIKKIKYGNKLNAHLDITDDYPNSRNKVVK LSLKPYRFDVYLDNGVYKFVTVKNLDVIKKENYYEVNSKCYEEAKKLKKISNQ AEFIASFYKNDLIKINGELYRVIGVNSDDRNIIELNMIDITYREYLENMNDKRP PHIIKTIASKTQSIKKYSTDILGNLYEVKSKKHPQIIKKG | | | | |
| cCas9-v42 | Staphylococcus aureus | MKRNVILGLDIGITSVGYGIIDYETRDVIDAGVRLFKEANVENNEGRSKRGA RRLKRRRHRIQRVKKLLFDYNLLTDHSELSGINPYEARVKGLSQKLSEEEFSA ALLHLAKRRGVHNVNEVEEDTGNELLSTKEQISRNSKALEEKYVAELQLERLKK DGEVRGSINRFKTSDYVKEAQLLKVQKAYHQLDQSFIDTYIDLLETRRTYYE GPGEGSPFGWKDIKEWYEMLMGHCTYFPEELRSVKYAYNADLYNALNDLN NLVITRDENEKLEYYEKFQIIENVFKQKKKPTLKQIAKEILVNEEDIKGYRVTST GKPEFTNLKVYHDIKDITARKEIIENAELLDQIAKILTIYQSSEDIQEELTNLNSE LTQEEIEQISNLKGYTGTHNLSLKAINLLIDELWHTNDNQIAIFNRLKLVPKKV DLSQQKEIPTTLVDDFILSPVVKRSFIQSIKVINAIIKKYGLPNDIIIELAREKNSK DAQKMINEMQKRNEQTNERIEEIIRTTGKENAKYLIEKIKLHDMQEGKCLYS LEAIPLEDLLNNPFNYEVDHIIPRSVSFDNSFNNKVLVKQEENSKKGNRTPFQ YLSSSDSKISYETFKKHILNLAKGKRISKTKKEYLLEERDINRFSVQKDFINRNL VDTRYATRGLMNLLRSYFRVNNLDVKVKSINGGFTSFLRRKWKFKKERNKG YKHHAEDALIIANADFIFKEWKKLDKAKKVMENQMFEEKQAESMPEIETEQ EYKEIFITPHQIKHIKDFKDYKYSHRVDKKPNRKLINDTLYSTRKDDKGNTLIV NNLNGLYDKNDKLKKLINKSPEKLLMYHHDPQTYQKLLIMEQYGDEKNP LYKYEETGNYLTKYSKKDNGPVIIKKIKYGNKLNAHLDITDDYPNSRNKVVK LSLKPYRFDVYLDNGVYKFVTVKNLDVIKKENYYEVNSKCYEEAKKLKKISNQ AEFIASFYKNDLIKINGELYRVIGVNNNRLNKIELNMIDITYREYLENMNDKRP PHIIKTIASKTQSIKKYSTDILGNLYEVKSKKHPQIIKKG | 9,016 | N580A | H557A | D10A |
| CdiCas9 | Corynebacterium diphtheriae | MKYHVGIDVGTFSVGLAAIEVDDAGMPIKTLSLVSHIHDSGLDPDEIKSAVT RLASSGIARRTRRLYRRKRRRLQQLDKFIQRQGWPVIELEDYSDPLYPWKVR AELAASYIADEKERGEKLSVALRHIARHRGWRNPYAKVSSLYLPDGPSDAFK AIREEIKRASGQPVPETATVGQMVTLCELGTLKLRGEGGVLSARLQQSDYAR EIQEICRMQEIGQELYRKIIDVVFAAESPKGSASSRVGKDPLQPCKNRALKAS DAFQRYRIAALIGNLRVRVDGEKRILSVEEKNLVFDHLVNLTPKKEPEWVTIA EILGIDRGQLIGTATMTDDGERAGARPPTHDTNRSIVNSRIAPLVDWWKTA SALEQHAMVKALSNAEVDDPDSPEGAKVQAFFADLLDDDVHAKLDSLHLPV GRAAYSEDTIVRLTRRMLSDGVDLYTARLQEFGIEPSWTPPTPRIGEPVGNP AVDRVLKTVSRWLESATKWGAPERVIIBHVREGFVTEKRAREMDGDMR RAARNAKLFQEMQERKLNVQGKPSRADLWRYQSVQRQNCQCAYCGSPITF SNSEMDHIVPRAGQQSTNTRENLVAVCHRCNQSKGNTPFAIWAKNTSIEG VSVKEAVERTRHWVTDTGMRSTDFFKFTKAVVERFQRAITMDEEIDARSME SVAWMANELRSRVAQHFASHGTTVRVRGSLTAEARRASGISGKLKFPDGV GKSRLDRRHHAIDAAVIAFTSDYVAETLAVRSNLKQSQAHRQEAPQWREFT GKDAEHRAAWRVWCQKMEKLSALLTEDLRLDRVVMSNVRLRLGNGSA HKETIGKLSKVKLSSQLSVSDIDKASSEAWCALTREPGDPKEGLPANPERHI | 9,017 | N597A | H573A | D8A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | RVNGTHVYAGDNIGLFPVSAGSIALRGGVYAELGSSFHHARVYKITSGKKPAF AMLRVYTIDLLPYRNQDLFSVELKPQTMSMRQAEKKLRDALATGNAEYLG WLVVDDELVVDTSKIATDQVKAVEAELGTIRRWRVDGFFSPSKLRLRPLQM SKEGIKKESAPELSKIIDRPGWLPAVNKLFSDGNVTVVRRDSLGRVRLESTAH LPVTWKVQ | | | | |
| CjeCas9 | Campylobacter jejuni | MARILAFDIGISSIGWAFSENDELKDCGVRIFTKVENPKTGESLALPRRLARSA RKRLARRKARLNHLKHLIANEFKLNYEDYQSFDESLAKAYKGSLISPYELRFRA LNELLSKQDFARVILHIAKRRGYDDIKNSDDKEKGAILKAIKQNEEKLANYQS VGEYLYKEYFQKFKENSKEFTNVRNKKESYERCIAQSFLKDELKLIFKKQREFG FSFSKKFEEEVLSVAFYKRALKDFSHLVGNCSFFTDEKRAPKNSPLAFMFVAL TRIINLLNNLKNTEGILYTKDDLNALLNEVLKNGTLTYKQTKKLLGLSDDYEFK GEKGTYFIEFKKYKEFIKALGEHNLSQDDLNEIAKDITLIKDEIKLKKALAKYDLN QNQIDSLSKLEFKDHLNISFKALKLVTPLMLEGKKYDEACNELNLKVAINEDK KDFLPAFNETYYKDEVTNPVVLRAIKEYRKVLNALLKKYGKVHKINIELAREVG KNHSQRAKIEKEQNENYAKKDADELECEKLGLKINSKNILKLRLFKEQKEFCAY SGEKIKISDLQDEKMLEIDHIYPYSRSFDDSYMNKVLVFTKQNQEKLNQTPFE AFGNDSAKWQKIEVLAKNLPTKKQRILDKNYKDKEQNFKDRNLNDTRYI ARLVLNYTKDYLDFLPLSDDENTKLNDTQKGSKVHVEAKSGMLTSALRHTW GFSAKDRNNHLHHAIDAVIIAYANNSIVKAFSDFKKEQESNSAELYAKKISELD YKNKRFFEPFSGFRQKVLDKIDEIFVSKPERKKPSGALHEETFRKEEEFYQSY GGKEGVLKALELGKIRKVNGKIVKNGDMPRVDIFKHKKTNKFYAVPIYTMDF ALKVLPNKAVARSKKGEIKDWILMDENYEFCFSLYKDSLLIQTRDMQEPEFV YYNAFTSSTVSLIVSKHDNKFETLSKNQKILFKNANEKEVIAKSIGIQNLKVFEK YIVSALGEVTKAEFRQREDFKK | 9,018 | N582A | H559A | D8A |
| GeoCas9 | Geobacillus stearothermo- philus | MRYKIGLDIGITSVGWAVMNLDIPRIEDLGVRIFDRAENPQTGESLALPRRLA RSARRRLRRKRHRLERIRRLVIREGILTKEELDKLFEEKHEIDVWQLRVEALDR KLNNDELARVLIHLAKRRGFKSNRKSERSNKENSTMLKHIEENRAILSYRTV GEMIVKDPKFALHKRNKGENYTNTIARDDLEREIRLIFSKQREFGNMSCTEEF ENEYITIWASQRPVASKDDIEKKVGFCTFEPKEKRAPKATYTFQSFIAWEHIN KLRLISPSGARGLTDEERRLLYEQAFQKNKITYHDIRTLLHLPDDTYFKGIVYDR GESRKQNENIRFLELDAYHQIRKAVDKVYGKGKSSSFLPIDFDTFGYALTLFKD DADIHSYLRNEYEQNGKRMPNLANKVYDNELIEELLNLSFTKFGHLSLKALRS ILPYMEQGEYYSSACERAGYTFTGPKKKQKTMLLPNIPPIANPVVMRALTQA RKVVNAIIKKYGSPVSIHIELARDLSQTFDERRKTKKEQDENRKKNETAIRQL MEYGLTLNPTGHDIVKFKLWSEQNGRCAYSLQPIEIERLLEPGVVEVDHVIPY SRSLDDSYTNKVLVLTRENREKGNRIPAEYLGVGTERWQQFETFVLTNKQFS KKKRDLLRLHYDENEETEFKNRNLNDTRYISRFFANFIREHLKFAESDDKQK VYTVNGRVTAHLRSRWEFNKNREESDLHHAVDAVIVACTTPSDIAKVTAFY QRREQNKELAKKTEPHFPQPWPHFADELRARLSKHPKESIKALNLGNYDDQ KLESLQPVFVSRMPKRSVTGAAHQETLRRYVGIDERSGKIQTVVKTKLSEIKL DASGHFPMYGKESDPRTYEAIRQRLLEHNNDPKKAFQEPLYKPKKNGEPGP VIRTVKIIDYKNQVIPLNDGKTVAYNSNIVRVDVPFEKDGKYYCVPYTMDIM KGILPNKAIEPNKPYSEWKEMTEDYTFRRSLYPNDLIRIELPREKTVKTAAGEE INVKDVFVYYKTIDSANGGLELISHDHRFSLRGVGSRTLKRFEKYQVDVLGNI YKVRGEKRVGLASSAHSKPGKTIRPLQSTRD | 9,019 | N605A | H582A | D8A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| iSpyMacCas9 | Streptococcus spp. | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNKREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKQKQKNSRERMKRIEEGIKELGSQ ILKEHPVENTQLQNEKLYLYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFKTEITLANGEI RKRPLIETNGETGEIVWDKGRDFATVRKVLSMPQVNIVKKTEIQTVGQNGG LFDDNPKSPLEVTPSKLVPLKKELNPKKYGGYQKPTTAYPVLLITDTKQLIPISV MNNKQFEQNFVKTVPLRDRGYQQVGKNDFIKLPKYTLVDIGDGIKRLWASSKEI HKGNQLVVSKKSQILLYHAHHLDSDLSNDYLQNHNQQFDVLFNEIISFSKKC KLGKEHIQKIENVYSNKKNSASIEELAESFIKLLGFTQLGATSPFNFLGVKLNQ KQYKGKKDYILPCTFGTLIRQSITGLYETRVDLSKIGEDSGSGSGSKRTADGSE FES | 9,020 | N863A | H840A | D10A |
| NmeCas9 | Neisseria meningitidis | MAAFKPNSINYILGLDIGIASVGWAMVEIDEEENPIRLIDLGVRVFERAEVPK TGDSLAMARRLARSVRRLTRRRAHRLLRTRRLLKREGVLQAANFDENGLIKS LPNTPWQLRAAALDRKLTPLEWSAVLLHLIKHRGYLSQRKNEGETADKELG ALLKGVAGNAHALQTGDFRTPAELALNKFEKESGHIRNQRSDYSHTFSRKDL QAELILLFEKQKEFGNPHVSGGLKEGIETLLMTQRPALSGDAVQKMLGHCTF EPAEPKAAKNTYTAERFIWLTKLNNLRILEQGSERPLTDTERATLMDEPYRKS KLTYAQARKLLGLEDTAFFKGLRYGKDNAEASTLMEMKAYHAISRALEKEGL KDKKSPLNLSPELQDEIGTAFSLFKTDEDITGRLKDRIQPEILEALLKHISFDKFV QISLKALRRIVPLMEQGKRYDEACAEIYGDHYGKKNTEEKIYLPPIPADEIRNP VVLRALSQARKVINGVVRRYGSPARIHIETAREVGKSFKDRKEIEKRQENRK DREKAAAKFREYFPNFVGEPKSKDILKLRLYEQOHGKCLYSGKEINLGRLNEK GYVEIDHALPFSRTWDDSFNNKVLVLGSENQNKGNQTPYEYFNGKDNSRE WQEFKARVETSRFPRSKKQRILLQKFDEDGFKERNLNDTRYVNRFLCQFVA DRMRLTGKGKKRVFASNGQITNLLRGFWGLRKVRAENDRHHALDAVVVA CSTVAMQQKITRFVRYKEMNAFDGKTIDKETGEVLHQKTHFPQPWEFFAQ EVMIRVFGKPDGKPFEEADTLEKLRTLLAEKLSSRPEAVHEYVTPLFVSRAP NRKMSGQGHMETVKSAKRLDEGVSVLRVPLTQLKDLREKMVNREREPKL YEALKARLEAHKDDPAKAFAEPFYKDAGNRTQQVKAVRVEQVQKTGVW VRNHNGIADNATMVRVDVFEKGKYLVPIYSWQVAKGILPDRAVVQGKD | 9,021 | N611A | H588A | D16A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| ScaCas9 | Streptococcus canis | EEDWQLIDDSFNFKFPSLHPNDLVEVITKKARMFGYFASCHRGTGNINIRIHD LDHKIGKNGILEGIGVKTALSFQKYQIDELGKEIRPCRLKKRPPVR MEKKYSIGLDIGTNSVGWAVITDDYKVPSKKFKVLGNTNRKSIKKNLMGALL FDSGETAEATRLKRTARRYTRRKNRIRYLQEIFANEMAKLDDSFFQRLEESF LVEEDKKNERHPIFGNLADEVAYHRNYPTIYHLRKKLADSPEKADLRLIYLALA HIIKPRGHFLIEGKLNAENSDVAKLFYQLIQTYNQLFEESPLDEIEVDAKGILSA RLSKSKRLEKLIAVPPNEKKNGLFGNIIALALGLTPNFKSNFDLTEDAKLQLSKD TYDDDLDELLGQIGDQYADLFSAAKNLSDAILLSDILRSNSEVTKAPLSASMV KRYDEHHQDLALLKTLVRQQFPEKYAEIFKDDTKNGYAGVGIGIKHRKRTT KLATQEEFYKFIKPILEKMDGAEELLAKLNRDDLLRKQRTFDNGSIPHQIHLKE LHAILRRQEEFYPFLKENREKIEKILTFRIPYYVGPLARGNSRFAWLTRKSEEAI TPWNFEEVVDKGASAQSFIERMTNFDEQLPNKKVLPKHSLLYEFTVYNELT KVKVTERMRKPEFLSGEQKKAIVDLLFKTNRKVTVKQLKEDYFKKIECFDSV EIIGVEDRFNASLGTYHDLLKIIKDKDFLDNEENEDILEDIVLTLTLFEDREMIEE RLKTYAHLFDDKVMKQLKRRHYTGWGRLSRKMINGIRDKQSGKTILDFLKS DGFSNRNFMQLIHDDSLTFKEEIEKAQVSGQGDSLHEQIADLAGSPAIKKGIL QTVKIVDELVKVMGHKPENIVIEMARENQTTTKGLQQSRERKKRIEEGIKELE SQILKENPVENTQLQNEKLYLYYLQNGRDMYVDQELDINRLSDYDVDHIVP QSFIKDDSIDNKVLTRSVENRGKSDNVPSEEVVKKMKNYWRQLLNAKLITQ RKFDNLTKABRGGLSEADKAGFIKRQLVETRQITKHVARILDSRMNTKRDKN DKPIREVKVITLKSKLVSDFRKDFQLYKVRDINNYHHAHDAYLNAVVGTALIK KYPKLESEFVYGDYKVYDVRKMIAKSEQEIGKATAKRFFYSNIMNFFKTEVKL ANGEIRKRPLIETNGETGEVVWNKEKDFATVRKVLAMPQVNIVKKTEVQTG GFSKESILSKRESAKLIPRKKGWDTRKYGGFGSPTVAYSILVVAKVEKGKAKKL KSVKVLVGITIMEKGSYEKDPIGFLEAKGYKDIKKELIFKLPKYSLFELENGRRR MLASATELQKANELVLPQHLVRLLYYTQNISATTGSNNLGYIEQREEFKEIF EKIIDFSEKYILNKNVNSNLKSSFDEQFAVSDSILLSNSFVSLLKYTSFGASGGFT FLDLDVKQGRLRYQTVTEVLDATLIYQSITGLYETRTDLSQLGGD | 9,022 | N872A | H849A | D10A |
| ScaCas9-HiFi-Sc++ | Streptococcus canis | MEKKYSIGLDIGTNSVGWAVITDDYKVPSKKFKVLGNTNRKSIKKNLMGALL FDSGETAEATRLKRTARRYTRRKNRIRYLQEIFANEMAKLDDSFFQRLEESF LVEEDKKNERHPIFGNLADEVAYHRNYPTIYHLRKKLADSPEKADLRLIYLALA HIIKPRGHFLIEGKLNAENSDVAKLFYQLIQTYNQLFEESPLDEIEVDAKGILSA RLSKSKRLEKLIAVPPNEKKNGLFGNIIALALGLTPNFKSNFDLTEDAKLQLSKD TYDDDLDELLGQIGDQYADLFSAAKNLSDAILLSDILRSNSEVTKAPLSASMV KRYDEHHQDLALLKTLVRQQFPEKYAEIFKDDTKNGYAGVGADKKLRKRS GKLATEEEFYKFIKPILEKMDGAEELLAKLNRDDLLRKQRTFDNGSIPHQIHLK ELHAILRRQEEFYPFLKENREKIEKILTFRIPYYVGPLARGNSRFAWLTRKSEEA ITPWNFEEVVDKGASAQSFIERMTNFDEQLPNKKVLPKHSLLYEFTVYNEL TKVKYVTERMRKPEFLSGEQKKAIVDLLFKTNRKVTVKQLKEDYFKKIECFDS VEIIGVEDRFNASLGTYHDLLKIIKDKDFIDNEENEDILEDIVLTLTLFEDREMIE ERLKTYAHLFDDKVMKQLKRRHYTGWGRLSRKMINGIRDKQSGKTILDFLKS DGFSNANFMQLIHDDSLTFKEEIEKAQVSGQGDSLHEQIADLAGSPAIKKGIL QTVKIVDELVKVMGHKPENIVIEMARENQTTTKGLQQSRERKRIEEGIKELE SQILKENPVENTQLQNEKLYLYYLQNGRDMYVDQELDINRLSDYDVDHIVP RKFDNLTKABRGGLSEADKAGFIKRQLVETRQITKHVARILDSRMNTKRDKN | 9,023 | N872A | H849A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | DKPIREVKVITLKSKLVSDFRKDFQLYKVRDINNYHHAHDAYLNAVVGTALIK KYPKLESEFVYGDYKVYDVRKMIAKSEQEIGKATAKRFFYSNIMNFFKTEVKL ANGEIRKRPLIETNGETGEVVWNKEKDFATVRKVLAMPQVNIVKKTEVQTG GFSKESILSKRESAKLIPRKKGWDTRKYGGFGSPTVAYSILVVAKVEKGKAKKL KSVKVLVGITIMEKGSYEKDPIGFLEAKGYKDIKKELIFKLPKYSLFELENGRRR MLASAKELQKANELVLPQHIVRLLYYTQNISATTGSNNLGYIEQHREEFKEIF EKIIDFSEKYILKNKVNSNLKSSFDEQFAVSDSILLSNSFVSLLKYTSFGASGGFT FLDLDVKQGRLRYQTVTEVLDATLIYQSITGLYETRTDLSQLGGD | | | | |
| SpyCas9-3var-NRRH | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFPHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MVKRYDEHHQDLTLLKALVRQQLPEKYKEIFFDQSKNGYAGYIDGGASQEE FYKFIKPILEKMDGTEELLVKLNREDLLRKQRTFDNGIIPHQIHLGELHAILRRQ GDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRLRYTGWGRLSRKLINGIRDKQSGKTILDFLKSDGFANRN FMQLIHDDSLTFKEDIQKAQVSGQGDSLHEHIANLAGSPAIKKGILQTVKVV DELVKVMGGHKPENIVIEMARENQTTQKGQKNSRERMKRIEEGIKELGSQI LKEHPVENTQLQNEKLYLYLQNGRDMYVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKGNSDKLIARKKDWDPKKYGGFNSPTAAYSVLVVAKVEKGKSKKLKSVK ELLGITIMERSSFEKNPIGFLEAKGYKEVKKDLIIKLPKYSLFELENGRKRMLAS AGVLHKGNELALPSKYVNFLYLASHYEKLKGSPEDNEQKQLFVEQHKHYLDE IIEQISEFSKRVILADANLDKVLSAVNKHRDKPIREQAENIIHLFTLTNLGVPAA FKYFDTTIDKKRYTSTKEVLDATLIHQSITGLYETRIDLSQLGGD | 9,024 | N863A | H840A | D10A |
| SpyCas9-3var-NRTH | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFPHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MVKRYDEHHQDLTLLKALVRQQLPEKYKEIFFDQSKNGYAGYIDGGASQEE FYKFIKPILEKMDGTEELLVKLNREDLLRKQRTFDNGIIPHQIHLGELHAILRRQ GDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA | 9,025 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | HLFDDKVMKQLKRLRYTGWGRLSRKLINGIRDKQSGKTILDFLKSDGFANRN FMQLIHDDSLTFKEDIQKAQVSGQGDSLHEHIANLAGSPAIKKGILQTVKVV DELVKVMGGHKPENIVIEMARENQTTQKGQKNSRERMKRIEEGIKELGSQI LKEHPVENTQLQNEKLYLYLQNGRDMYVDQELDINRLSDYDVDHIVPQSF LKDDSIDNKVLTRSDKNRGKSDNVPSEEVVKKMKNYWRQLLNAKLITQRKF DNLTKAERGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKGNSDKLIARKKDWDPKKYGGFNSPTVAYSVLVVAKVEKGKSKKLKSVK ELLGITIMERSSFEKNPIDPFLEAKGYKEVKKDLIIKLPKYSLFELENGRKRMLAS ASVLHKGNELALPSKYVNFLYLASHYEKLKGSSEDNKQKQLFVEQHKHYLDEI IEQISEFSKRVILADANLDKVLSAYNKHRDKPIREQAENIIHLFTLTNLGASAAF KYFDTTIGRKLYTSTKEVLDATLIHQSITGLYETRIDLSQLGD | | | | |
| SpyCas9-3var-NRCH | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MVKRYDEHHQDLTLLKALVRQQLPEKYKEIFFDQSKNGYAGYIDGGASQEE FYKFIKPILEKMDGTEELIVKLNREDLLRKQRTFDNGIIPHQIHLGELHAILRRQ GDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYTE GMRKPAFLSGEQKKAIVDLLFKTNRKVTVKQLKEDYFKKIECFDSVEISGVED RFNASLGTYHDLLKIIKDKDFLDNENEDILEDIVLTLTLFEDREMIEERLKTYA HLFDDKVMKQLKRLRYTGWGRLSRKLINGIRDKQSGKTILDFLKSDGFANRN FMQLIHDDSLTFKEDIQKAQVSGQGDSLHEHIANLAGSPAIKKGILQTVKVV DELVKVMGGHKPENIVIEMARENQTTQKGQKNSRERMKRIEEGIKELGSQI LKEHPVENTQLQNEKLYLYLQNGRDMYVDQELDINRLSDYDVDHIVPQSF LKDDSIDNKVLTRSDKNRGKSDNVPSEEVVKKMKNYWRQLLNAKLITQRKF DNLTKAERGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKGNSDKLIARKKDWDPKKYGGFNSPTVAYSVLVVAKVEKGKSKKLKSVK ELLGITIMERSSFEKNPIDPFLEAKGYKEVKKDLIIKLPKYSLFELENGRKRMLAS AGVLQKGNELALPSKYVNFLYLASHYEKLKGSPEDNEQKQLFVEQHKHYLDE IIEQISEFSKRVILADANLDKVLSAYNKHRDKPIREQAENIIHLFTLTNLGAPAA FKYFDTTINRKQYNTTKEVLDATLIRQSITGLYETRIDLSQLGGD | 9,026 | N863A | H840A | D10A |
| SpyCas9-HF1 | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS | 9,027 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVRYTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFDSPTVAYSVLVVAKVEKGKSKKLKSVKE LLGITIMERSSFEKNPIDFLEAKGYKEVKKDLIIKLPKYSLFELENGRKRMLASA GELQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAF KYFDTTIDRKRYTSTKEVLDATLIHQSITGLYETRIDLSQLGGD | | | | |
| SpyCas9-QQR1 | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFPHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVRYTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFDSPTVAYSVLVVAKVEKGKSKKLKSVKE LLGITIMERSSFEKNPIDFLEAKGYKEVKKDLIIKLPKYSLFELENGRKRMLASA RELQKGNELALPSKYVNFLYLASHYEKLKGSPEDNEQKQLFVEQHKHYLDEII EQISEFSKRVILADAQLDKVLSAYNKHRDKPIREQAENIIHLFTLTNLGAPAAF KYFDTTFKQYRSTKEVLDATLIHQSITGLYETRIDLSQLGGD | 9,028 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| SpyCas9-SpG | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFLWPTVAYSVLVVAKVEKGKSKKLSVK ELLGITIMERSSFEKNPIDFLEAKGYKEVKKDLIIKLPKYSLFELENGRKRMLAS AKQLQKGNELALPSKYVNFLYLASHYEKLKGSPEDNEQKQLFVEQHKHYLDE IIEQISEFSKRVILADANLDKVLSAYNKHRDKPIREQAENIIHLFTLTNLGAPAA FKYFDTTIDRKQYRSTKEVLDATLIHQSITGLYETRIDLSQLGD | 9,029 | N863A | H840A | D10A |
| SpyCas9-VQR | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYVTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES | 9,030 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | ILPKRNSDKLIARKKDWDPKKYGGFVSPTVAYSVLVVAKVEKGKSKKLKSVKE LLGITIMERSSFEKNPIDFLEAKGYKEVKKDLIIKLPKYSLFELENGRKRMLASA GELQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAF KYFDTTIDRKQYRSTKEVLDATLIHQSITGLYETRIDLSQLGD | | | | |
| SpyCas9-VRER | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFPHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDAKLQLS KDTYDDDLDNLLAQIGDQYADLFLAAKNLSDAILLSDILRVNTEITKAPLSAS MIKRYDEHHQDLTLLKALVRQQLPEKYKEIFFDQSKNGYAGYIDGGASQEEF YKFIKPILEKMDGTEELLVKLNREDLLRKQRTFDNGSIPHQIHLGELHAILRRQ EDFYPFLKDNREKIEKILTFRIPYYVGPLARGNSRFAWMTRKSEETITPWNFE EVVDKGASAQSFIERMTNFDKNLPNEKVLPKHSLLYEYFTVYNELTKVKYTE GMRKPAFLSGEQKKAIVDLLFKTNRKVTVKQLKEDYFKKIECFDSVEISGVED RFNASLGTYHDLLKIIKDKDFLDNEENEDILEDIVLTLTLFEDREMIEERLKTYA HLFDDKVMKQLKRRYTGWGRLSRKLINGIRDKQSGKTILDFLKSDGFANR NFMQLIHDDSLTFKEDIQKAQVSGQGDSLHEHIANLAGSPAIKKGILQTVKV VDELVKVMGRHKPENIVIEMARENQTTQKGQKNSRERMKRIEEGIKELGSQ ILKEHPVENTQLQNEKLYLYLQNGRDMVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFVSPTVAYSVLVVAKVEKGKSKKLKSVKE LLGITIMERSSFEKNPIDFLEAKGYKEVKKDLIIKLPKYSLFELENGRKRMLASA RELQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAF KYFDTTIDRKEYRSTKEVLDATLIHQSITGLYETRIDLSQLGD | 9,031 | N863A | H840A | D10A |
| SpyCas9-xCas | Streptococcus pyogenes | MDKKYSIGLDIGTNSVGWAVITDEYKVPSKKFKVLGNTDRHSIKKNLIGALLF DSGETAEATRLKRTARRRYTRRKNRICYLQEIFSNEMAKVDDSFPHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDTKLQLS KDTYDDDLDNLLAQIGDQYADLFLAAKNLSDAILLSDILRVNTEITKAPLSAS MIKLYDEHHQDLTLLKALVRQQLPEKYKEIFFDQSKNGYAGYIDGGASQEEF YKFIKPILEKMDGTEELLVKLNREDLLRKQRTFDNGIIPHQIHLGELHAILRRQE DFYPFLKDNREKIEKILTFRIPYYVGPLARGNSRFAWMTRKSEETITPWNFEK VVDKGASAQSFIERMTNFDKNLPNEKVLPKHSLLYEYFTVYNELTKVKVTE GMRKPAFLSGDQKKAIVDLLFKTNRKVTVKQLKEDYFKKIECFDSVEISGVED RFNASLGTYHDLLKLIKDKDFLDNEENEDILEDIVLTLTLFEDREMIEERLKTYA HLFDDKVMKQLKRRYTGWGRLSRKLINGIRDKQSGKTILDFLKSDGFANR NFIQLIHDDSLTFKEDIQKAQVSGQGDSLHEHIANLAGSPAIKKGILQTVKVV DELVKVMGRHKPENIVIEMARENQTTQKGQKNSRERMKRIEEGIKELGSQI | 9,032 | N863A | H840A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | LKEHPVENTQLQNEKLYLYLQNGRDMYVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES ILPKRNSDKLIARKKDWDPKKYGGFDSPTVAYSVLVVAKVEKGKSKKLKSVKE LLGITIMERSSFEKNPIDFLEAKGYKEVKKDLIIKLPKYSLFELENGRKRMLASA GVLQKGNELALPSKYVNFLYLASHYEKLKGSPEDNEQKQLFVEQHKHYLDEII EQISEFSKRVILADANLDKVLSAYNKHRDKPIREQAENIIHLFTLTNLGAPAAF KYFDTTIDRKRYTSTKEVLDATLIHQSITGLYETRIDLSQLGGD | | | | |
| SpyCas9- xCas-NG | Streptococcus pyogenes | MDKKYSIGLDIGTNSVGWAVITDEYKVPSKKFKVLGNTDRHSIKKNLIGALLF DSGETAEATIKLRTARRRYTRRKNRICYLQEIFSNEMAKVDDSFFHRLEESFL VEEDKKHERHPIFGNIVDEVAYHEKYPTIYHLRKKLVDSTDKADLRLIYLALAH MIKFRGHFLIEGDLNPDNSDVDKLFIQLVQTYNQLFEENPINASGVDAKAILS ARLSKSRRLENLIAQLPGEKKNGLFGNLIALSLGLTPNFKSNFDLAEDTKLQLS KDTYDDDLDNLLAQIGDQYADLFLAAKNLSDAILLSDILRVNTEITKAPLSSA MIKLYDEHHQDLTLLKALVRQQLPEKYKEIFFDQSKNGYAGYIDGGASQEEF YKFIKPILEKMDGTEELLVKLNREDLLRKQRTFDNGIIPHQIHLGELHAILRRQE DFYPFLKDNREKIEKILTFRIPYYVGPLARGNSRFAWMTRKSEETITPWNFEK VVDKGASAQSFIERMTNFDKNLPNEKVLPKHSLLYEYFTVYNELTKVKVTE GMRKPAFLSGDQKKAIVDLLFKTNRKVTVKQLKEDYFKKIECFDSVEISGVED RFNASLGTYHDLLKIIKDFLDNEENEDILEDIVLTLTLFEDREMIEERLKTYA HLFDDKVMKQLKRRRYTGWGRLSRKLINGIRDKQSGKTILDFLKSDGFANR NFIQLIHDDSLTFKEDIQKAQVSGQGDSLHEHIANLAGSPAIKKGILQTVKVV DELVKVMGRHKPENIVIEMARENQTTQKGQKNSRERMKRIEEGIKELGSQI LKEHPVENTQLQNEKLYLYLQNGRDMYVDQELDINRLSDYDVDHIVPQSF LKDDSIDNKVLTRSDKNRGKSDNVPSEEVVKKMKNYWRQLLNAKLITQRKF DNLTKAERGGLSELDKAGFIKRQLVETRQITKHVAQILDSRMNTKYDENDKLI REVKVITLKSKLVSDFRKDFQFYKVREINNYHHAHDAYLNAVVGTALIKKYPK LESEFVYGDYKVYDVRKMIAKSEQEIGKATAKYFFYSNIMNFFKTEITLANGEI RKRPLIETNGETGEIVWDKGRDFATVRKVLSMPQVNIVKKTEVQTGGFSKES IRPKRNSDKLIARKKDWDPKKYGGFVSPTVAYSVLVVAKVEKGKSKKLKSVKE LLGITIMERSSFEKNPIDFLEAKGYKEVKKDLIIKLPKYSLFELENGRKRMLASA RFLQKGNELALPSKRVILADANLDKVLSAYNKHRDKPIREQAENIIHLFTLTNLGAPRAF KYFDTTIDRKVYRSTKEVLDATLIHQSITGLYETRIDLSQLGGD | 9,033 | N863A | H840A | D10A |
| St1Cas9- CNRZ1066 | Streptococcus thermophilus | MSDLVLGLDIGIGSVGVGIILNKVTGEIIHKNSRIFPAAQAENNLVRRTNRQG RRLARRKKHRRVRLNRLFEESGLITDFTKISINLNPYQLRVKGLTDELSNEELFI ALKNMVKHRGISYLDDASDDGNSSVGDYAQIVKENSKQLETKTPGQIQLER YQTYGQLRGDFTVEKDGKKHRLINVFPTSAYRSEALRILQTQQEFNPQITDEF INRYLEILTGKRKYYHGPGNEKSRTDYGRYRTSGETLDNIFGILIGKCTFYPDEF RAAKASYTAQEFNLLNDLNNLTVPTETKKLSKEQKNQIINYVKNEKAMGPAK LFKYIAKLLSCDVADIKGYRIDKSGKAEIHTFEAYRKMKTLETLDIEQMDRETL DKLAYVLTLNTEREGIQEALEHEFADGSFSQKQVDELVQFRKANSSIFGKGW HNFSVKLMMELIPELYETSEEQMTILTRLGKQKTTSSSNKTKYIDEKLLTEEIY | 9,034 | N622A | H599A | D9A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| St1Cas9-LMG1831 | Streptococcus thermophilus | NPVVAKSVRQAIKIVNAAIKEYGDFDNIVIEMARETNEDDEKKAIQKIQKAN KDEKDAAMLKAANQTNGKAELPHSVFHGHKQLATKIRLWHQQGERCLYT GKTISIHDLINNSNQFEVDHILPLSITFDDSLANKVLVVATANQEKGQRTPYQ ALDSMDDAWSFRELKAFVRESKTLSNKKEYLLTEEDISKFPDVRKKFIERNLV DTRYASRVVLNALQEHFRAHKIDTKVSVVRGQFTSQLRRHWGIEKTRDTYH HHAVDALIIAASSQLNLWKKQKNTLVSYSEEQLLDIETGELISDDEYKESVFKA PYQHFVDTLKSKEFEDSILFSYQVDSKFNRKISDATIYATRQAKVGKDKKDET YVLGKIKDIYTQDGYDAFMKIYKKDKSKFLMYRHDPQTFEKVIEPILENYPNK QMNEKGKEVPCNPFLKYKEEHGYIRKYSKKGNGPEIKSLKYDSKLLGNPIDI TPENSKNKVVLQSLKPWRTDVYFNKATGKYEILGLKYADLQFEKGTGYKIS QEKYNDIKKKEGVDSDSEFKFTLYKNDLLLVKDTETKEQQLFRFLSRTLPKQK HYVELKPYDKQKFEGGEALIKVLGNVANGGQCIKGLAKSNISIYKVRTDVLG NQHIIKNEGDKPKLDF | | | | |
| | | MSDLVLGLDIGIGSVGVGIILNKVTGEIIHKNSRIFPAAQAENNLVRRTNRQG RRLARRKKHRRVRLNRLFEESGLITDFTKISINLNPYQLRVKGLTDELSNEELFI ALKNMVKHRGISYLDDASDDGNSSVGDYAQIVKENSKQLETKTPGQIQLER YQTYGQLRGDFTVEKDGKKHRLINVFPTSAYRSEALRILQTQQEFNPQITDEF INRYLEILTGKRKYYHGPGNEKSRTDYGRYRTSGETLDNIFGILIGKCTFYPDEF RAAKASYTAQEFNLLNDLNNLTVPETKKLSKEQKNQIINYVKNEKAMGPAK LFKYIAKLLSCDVADIKGYRIDKSGKAEIHTFEAYRKMKTLETLDIEQMDRETL DKLAYVLTLNTEREGIQEALEHEFADGSFSQKQVDELVQFRKANSSIFGKGW HNFSVKLMMELIPELYETSBEQMTILTRLGKQKTTSSSNKTKYIDEKLLTEEIY NPVVAKSVRQAIKIVNAAIKEYGDFDNIVIEMARETNEDDEKKAIQKIQKAN KDEKDAAMLKAANQTNGKAELPHSVFHGHKQLATKIRLWHQQGERCLYT GKTISIHDLINNSNQFEVDHILPLSITFDDSLANKVLVVATANQEKGQRTPYQ ALDSMDDAWSFRELKAFVRESKTLSNKKEYLLTEEDISKFPDVRKKFIERNLV DTRYASRVVLNALQEHFRAHKIDTKVSVVRGQFTSQLRRHWGIEKTRDTYH HHAVDALIIAASSQLNLWKKQKNTLVSYSEEQLLDIETGELISDDEYKESVFKA PYQHFVDTLKSKEFEDSILFSYQVDSKFNRKISDATIYATRQAKVGKDKKDET YVLGKIDIYTQDGYDAFMKIYKKDKSKFLMYRHDPQTFEKVIEPILENYPNK QMNEKGKEVPCNPFLKYKEEHGYIRKYSKKGNGPEIKSLKYADLQFEKKTGTYKISQ EKYNGIMKEEGVDSDSEFKPTLYKNDLLLVKDTETKEQQLFRFLSRTMPNVK YYVELKPYSKDKFEKNESLIEILGSADKSGRCIKGLGKSNISIYKVRTDVLGNQH IIKNEGDKPKLDF | 9,035 | N622A | H599A | D9A |
| St1Cas9-MTH17CL396 | Streptococcus thermophilus | MSDLVLGLDIGIGSVGVGIILNKVTGEIIHKNSRIFPAAQAENNLVRRTNRQG RRLARRKKHRRVRLNRLFEESGLITDFTKISINLNPYQLRVKGLTDELSNEELFI ALKNMVKHRGISYLDDASDDGNSSVGDYAQIVKENSKQLETKTPGQIQLER YQTYGQLRGDFTVEKDGKKHRLINVFPTSAYRSEALRILQTQQEFNPQITDEF INRYLEILTGKRKYYHGPGNEKSRTDYGRYRTSGETLDNIFGILIGKCTFYPDEF RAAKASYTAQEFNLLNDLNNLTVPETKKLSKEQKNQIINYVKNEKAMGPAK LFKYIAKLLSCDVADIKGYRIDKSGKAEIHTFEAYRKMKTLETLDIEQMDRETL DKLAYVLTLNTEREGIQEALEHEFADGSFSQKQVDELVQFRKANSSIFGKGW HNFSVKLMMELIPELYETSBEQMTILTRLGKQKTTSSSNKTKYIDEKLLTEEIY NPVVAKSVRQAIKIVNAAIKEYGDFDNIVIEMARETNEDDEKKAIQKIQKAN KDEKDAAMLKAANQTNGKAELPHSVFHGHKQLATKIRLWHQQGERCLYT | 9,036 | N622A | H599A | D9A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | GKTISIHDLINNSNQFEVDHILPLSITFDDSLANKVLVVATANQEKGQRTPYQ ALDSMDDAWSFRELKAFVRESKTLSNKKEYLLTEEDISKFDVRKKFIERNLV DTRYASRVVLNALQEHFRAHKIDTKVSVVRGQFTSQLRRHWGIEKTRDTYH HHAVDALIIAASSQLNLWKKQKNTLVSYQVDSKFNRKISDATIYATRQAKVGKDKADE APYQHFVDTLKSKEFEDSILFSYQVDSKFNRKISDATIYATRQAKVGKDKADE TYVLGKIKDIYTQDGYDAFMKIYKKDKSKFLMYRHDPQTFEKVIEPILENYPN KQINEKGKEVPCNPPLKYKEEHGYIRKYSKKGNGPEIKSLKYTDSKLGNHIDIT PKDSNNKVVLQSLKPWRTDVYFNKNTGKYEILGLKYSDMQFEKGTGKYSISK EQYENIKVREGVDENSEFKPTLYKNDLLLLKDSENGEQILLRFTSRNDTSKHYV ELKPYNRQKFPEGSEYLIKSLGTVAKGGQCIKGLGKSNISIYKVRTDVLGNQHII KNEGDKPKLDF | | | | |
| StlCas9-TH1477 | Streptococcus thermophilus | MSDLVLGLDIGIGSVGVGILNKVTGEIIHKNSRIPPAAQAENNLVRRTNRQG RRLARRKHRRVRLNRLFEESGLITDFTKISINLNPYQLRVKGLTDELSNEELFI ALKNMVKHRGISYLDDASDDGNSSVGDYAQIVKENSKQLETKTPCQIQLER YQTYGQLRGDFTVEKDGKKHRLINVFPTSAYRSREALRILQTQQEFNPQITDEF INRYLEILTGKRKYYHGPGNEKSRTDYGRYRTSGETLDNIFGILIGKCTFYPDEF RAAKASYTAQEFNLLNDLNNLTVPTETKKLSKEQKNQIINYVKNEKAMGPAK LFKYIAKLLSCDVADIKGYRIDKSGKAEIHTFEAYRKMKTLETLDIEQMDRETL DKLAYVLTLNTEREGIQEALEHEFADGSFSQKQVDELVQFRKANSSIFGKGW HNFSVKLMMELIPELYETSEEQMTILTRLGKQKTTSSSNKTKYIDEKLLTEEIY NPVVAKSVRQAIKVNAAIKEYGDFDNIVIEMARETNEDDEKKAIQKIQKAN KDEKDAAMLKAANQTNGKAELPHSVFHGHKQLATKIRLWHQQGERCLYT GKTISIHDLINNSNQFEVDHILPLSITFDDSLANKVLVVATANQEKGQRTPYQ ALDSMDDAWSFRELKAFVRESKTLSNKKEYLLTEEDISKFDVRKKFIERNLV DTRYASRVVLNALQEHFRAHKIDTKVSVVRGQFTSQLRRHWGIEKTRDTYH HHAVDALIIAASSQLNLWKKQKNTLVSYSDQLDIETGELISDDEYKESVFK APYQHFVDTLKSKEFEDSILFSYQVDSKFNRKISDATIYATRQAKVGKDKADE TYVLGKIKDIYTQDGYDAFMKIYKKDKSKFLMYRHDPQTFEKVIEPILENYPN KQINEKGKEVPCNPPLKYKEEHGYIRKYSKKGNGPEIKSLKYTDSKLGNHIDIT PKDSNNKVVLQSLKPWRTDVYFNKNTGKYEILGLKYSDMQFEKGTGKYSISK EQYENIKVREGVDENSEFKPTLYKNDLLLLKDSENGEQILLRFTSRNDTSKHYV ELKPYNRQKFPEGSEYLIKSLGTVVKGGRCIKGLGKSNISIYKVRTDVLGNQHIIK NEGDKPKLDF | 9,037 | N622A | H599A | D9A |
| sRGN3.1 | Staphylococcus spp. | MNQKFILGLDIGITSVGYGLIDYETKNIIDAGVRLFPEANVENNEGRRSKRGS RRLKRRRIHRLERVKLLLTEYDLINKEQIPTSNNPYQIRVKGLSEILSKDELAIAL LHLAKRRGIHNVDVAADKEETASDSLSTKDQINKNAKFLESRYVCELQKERLE NEGHVRGVENRFLTKDIVREAKKIDTQMQYYPEIDETFKEKYISLVETRREYF EGPQGQSPFGWNGDLKKWYEMLMGHCTYFPQELRSVKVAYSADLFNALN DLNNLIIQRDNSEKLEYHEKYHIIENVFKQKKKPTLKQIAKEIGVNPEDIKGYRI TKSGTPEFTSFKLFHDLKKVVKDHAILDIDLLNQIAEILTIYQDKDSIVAELGQ LEYLMSEADKQSISELTGVTGTHSLSLKCMNMIIDELWHSSMNQMEVFTYL NMRPKKYELKGYQRIPTDMIDDAILSPVVKRTFIQSINVINKVIEKYGIPEDIIIE LARENNSDDRKKFINNLQKKNEATRKRINEIIGQTGNQNAKRIVEKIRLHDQ QEGKCLYSLESIPLEDLLNNPNHYEVDHIIPRSVSFDNSYHNKVLVKQSENSK KSNLTPYQYFNSGKSKLSYNQFKQHILNLSKSQDRISKKKKEYLLEERDINKFE VQKEFINRNLVDTRYATRELTNYLKAYFSANNMNVKVKTINGSFTDYLRKV | 9,038 | N585A | H562A | D10A |

TABLE 8-continued

Amino Acid Sequences of CRISPR/Cas Proteins, Species, and Mutations

| Variant | Parental Host(s) | Protein Sequence | SEQ ID NO: | Nickase (HNH) | Nickase (HNH) | Nickase (RuvC) |
|---|---|---|---|---|---|---|
| | | WKFKKERNHGYKHAEDALIIANADFLFKENKKLKAVNSVLEKPEIETKQLDI QVDSEDNYSEMFIIPKQVQDIKDFRNFKYSHRVDKKPNRQLINDTLYSTRKK DNSTYIVQTIKDIYAKDNITLKKQFDKSPEKFLMYQHDPRTFEKLEVIMKQYA NEKNPLAKYHEETGEYLTKYSKKNNGPIVKSLKYIGNKLGSHLDVTHQFKSST KKLVKLSIKNYRFDVYLTEKGYKFVTIAYLNVFKKDNYYIPKDKYQELKEKKKI KDTDQFIASFYKNDLIKLNGDLYKIIGVNSDDRNIIELDYYDIKYKDYCEINNIK GEPRIKKTIGKKTESIEKFTTDVLGNLYLHSTEKAPQLIFKRGL | | | | |
| sRGN3.3 | Staphylococcus spp. | MNQKFILGLDIGITSVGYGLIDYETKNIIDAGVRLFPEANVENNEGRRSKRGS RRLKRRRIHRLERVKLLLTEYDLINKEQIPTSNNPYQIRVKGLSEILSKDELAIAL LHLAKRRGIHNVDVAADKEETASDSLSTKDQINKNAKFLESRYVCELQKERLE NEGHVRGVENRFLTKDIVREAKKIIDTQMQYYPEIDETFKEKYISLVETRREYF EGPGQGSPFGWNGDLKKWYEMLMGHCTYFPQELRSVKYAYSADLFNALN DLNNLIIQRDNSEKELEYHEKYHIIENVFKQKKPTLKQIAKEIGVNPEDIKGYRI TKSGTPEFTSFKLFHDLKKVVKDHAILDDIDLLNQIAEILTIYQDKDSIVAELGQ LEYLMSEADKQSISELTGYTGTHSLSLKCMNMIIDELWHSSMNQMEVFTYL NMRPKKYELKGYQRIPTDMIDDAILSPVVKRTFIQSINVINKVIEKYGIPEDIIIE LARENNSDDRKKFINNLQKKNEATRKRINEIIGQTGNQNAKRIVEKIRLHDQ QEGKCLYSLESIPLEDLLNNPNHYEVDHIIPRSVSFDNSYHNKVLVKQSENSK KSNLTPYQYFNSGKSKLSVNQFKQHILNLSKSQDRISKKKEYLLEERDINKFE VQKEFINRNLVDTRYATRELTSYLKAYFSANNMDVKVKTINGSFTNHLRKV WRFDKYRNHGYKHAEDALIIANADFLFKENKKLQNTNKILEKPTIENNTKK VTVEKEEDYNNVFETPKLVEDIKQYRDYKFPSHRVDKKPNRQLINDTLYSTRM KDEHDYIVQTITDIYGKDNTNLKKQFNKNPEKFLMYQNDPKTFEKLSIIMKQ YSDEKNPLAKYYEETGEYLTKYSKKNNGPIVKKIKLLGNKVGNHLDVTNKYEN STKKLVKLSIKNYRFDVYLTEKGYKFVTIAYLNVFKKDNYYIPKDKYQELKEKK KIKDTDQFIASFYKNDLIKLNGDLYKIIGVNSDDRNIIELDYYDIKYKDYCEINNI KGEPRIKKTIGKKTESIEKFTTDVLGNLYLHSTEKAPQLIFKRGL | 9,039 | N585A | H562A | D10A |

In some embodiments, a Cas protein requires a protospacer adjacent motif (PAM) to be present in or adjacent to a target DNA sequence for the Cas protein to bind and/or function. In some embodiments, the PAM is or comprises, from 5' to 3', NGG, YG, NNGRRT, NNNRRT, NGA, TYCV, TATV, NTTN, or NNNGATT, where N stands for any nucleotide, Y stands for C or T, R stands for A or G, and V stands for A or C or G. In some embodiments, a Cas protein is a protein listed in Table 7 or 8. In some embodiments, a Cas protein comprises one or more mutations altering its PAM. In some embodiments, a Cas protein comprises E1369R, E1449H, and R1556A mutations or analogous substitutions to the amino acids corresponding to said positions. In some embodiments, a Cas protein comprises E782K, N968K, and R1015H mutations or analogous substitutions to the amino acids corresponding to said positions. In some embodiments, a Cas protein comprises D1135V, R1335Q, and T1337R mutations or analogous substitutions to the amino acids corresponding to said positions. In some embodiments, a Cas protein comprises S542R and K607R mutations or analogous substitutions to the amino acids corresponding to said positions. In some embodiments, a Cas protein comprises S542R, K548V, and N552R mutations or analogous substitutions to the amino acids corresponding to said positions. Exemplary advances in the engineering of Cas enzymes to recognize altered PAM sequences are reviewed in Collias et al Nature Communications 12:555 (2021), incorporated herein by reference in its entirety.

In some embodiments, the Cas protein is catalytically active and cuts one or both strands of the target DNA site. In some embodiments, cutting the target DNA site is followed by formation of an alteration, e.g., an insertion or deletion, e.g., by the cellular repair machinery.

In some embodiments, the Cas protein is modified to deactivate or partially deactivate the nuclease, e.g., nuclease-deficient Cas9. Whereas wild-type Cas9 generates double-strand breaks (DSBs) at specific DNA sequences targeted by a gRNA, a number of CRISPR endonucleases having modified functionalities are available, for example: a "nickase" version of Cas9 that has been partially deactivated generates only a single-strand break; a catalytically inactive Cas9 ("dCas9") does not cut target DNA. In some embodiments, dCas9 binding to a DNA sequence may interfere with transcription at that site by steric hindrance. In some embodiments, dCas9 binding to an anchor sequence may interfere with (e.g., decrease or prevent) genomic complex (e.g., ASMC) formation and/or maintenance. In some embodiments, a DNA-binding domain comprises a catalytically inactive Cas9, e.g., dCas9. Many catalytically inactive Cas9 proteins are known in the art. In some embodiments, dCas9 comprises mutations in each endonuclease domain of the Cas protein, e.g., D10A and H840A or N863A mutations. In some embodiments, a catalytically inactive or partially inactive CRISPR/Cas domain comprises a Cas protein comprising one or more mutations, e.g., one or more of the mutations listed in Table 7. In some embodiments, a Cas protein described on a given row of Table 7 comprises one, two, three, or all of the mutations listed in the same row of Table 7. In some embodiments, a Cas protein, e.g., not described in Table 7, comprises one, two, three, or all of the mutations listed in a row of Table 7 or a corresponding mutation at a corresponding site in that Cas protein.

In some embodiments, a Cas9 derivative with enhanced activity may be used in the gene modification polypeptide. In some embodiments, a Cas9 derivative may comprise mutations that improve activity of the HNH endonuclease domain, e.g., SpyCas9 R221K, N394K, or mutations that improve R-loop formation, e.g., SpyCas9 L1245V, or comprise a combination of such mutations, e.g., SpyCas9 R221K/N394K, SpyCas9 N394K/L1245V, SpyCas9 R221K/L1245V, or SpyCas9 R221K/N394K/L1245V (see, e.g., Spencer and Zhang Sci Rep 7:16836 (2017), the Cas9 derivatives and comprising mutations of which are incorporated herein by reference). In some embodiments, a Cas9 derivative may comprise one or more types of mutations described herein, e.g., PAM-modifying mutations, protein stabilizing mutations, activity enhancing mutations, and/or mutations partially or fully inactivating one or two endonuclease domains relative to the parental enzyme (e.g., one or more mutations to abolish endonuclease activity towards one or both strands of a target DNA, e.g., a nickase or catalytically dead enzyme). In some embodiments, a Cas9 enzyme used in a system described herein may comprise mutations that confer nickase activity toward the enzyme (e.g., SpyCas9 N863A or H840A) in addition to mutations improving catalytic efficiency (e.g., SpyCas9 R221K, N394K, and/or L1245V). In some embodiments, a Cas9 enzyme used in a system described herein is a SpyCas9 enzyme or derivative that further comprises an N863A mutation to confer nickase activity in addition to R221K and N394K mutations to improve catalytic efficiency.

In some embodiments, a catalytically inactive, e.g., dCas9, or partially deactivated Cas9 protein comprises a D11 mutation (e.g., D11A mutation) or an analogous substitution to the amino acid corresponding to said position. In some embodiments, a catalytically inactive Cas9 protein, e.g., dCas9, or partially deactivated Cas9 protein comprises a H969 mutation (e.g., H969A mutation) or an analogous substitution to the amino acid corresponding to said position. In some embodiments, a catalytically inactive Cas9 protein, e.g., dCas9, or partially deactivated Cas9 protein comprises a N995 mutation (e.g., N995A mutation) or an analogous substitution to the amino acid corresponding to said position. In some embodiments, a catalytically inactive Cas9 protein, e.g., dCas9, comprises mutations at one, two, or three of positions D11, H969, and N995 (e.g., D11A, H969A, and N995A mutations) or analogous substitutions to the amino acids corresponding to said positions.

In some embodiments, a catalytically inactive Cas9 protein, e.g., dCas9, or partially deactivated Cas9 protein comprises a D10 mutation (e.g., a D10A mutation) or an analogous substitution to the amino acid corresponding to said position. In some embodiments, a catalytically inactive Cas9 protein, e.g., dCas9, or partially deactivated Cas9 protein comprises a H557 mutation (e.g., a H557A mutation) or an analogous substitution to the amino acid corresponding to said position. In some embodiments, a catalytically inactive Cas9 protein, e.g., dCas9, comprises a D10 mutation (e.g., a D10A mutation) and a H557 mutation (e.g., a H557A mutation) or analogous substitutions to the amino acids corresponding to said positions.

In some embodiments, a catalytically inactive Cas9 protein, e.g., dCas9, or partially deactivated Cas9 protein comprises a D839 mutation (e.g., a D839A mutation) or an analogous substitution to the amino acid corresponding to said position. In some embodiments, a catalytically inactive Cas9 protein, e.g., dCas9, or partially deactivated Cas9 protein comprises a H840 mutation (e.g., a H840A mutation) or an analogous substitution to the amino acid corresponding to said position. In some embodiments, a catalytically inactive Cas9 protein, e.g., dCas9, or partially deactivated Cas9 protein comprises a N863 mutation (e.g., a N863A mutation) or an analogous substitution to the amino acid corresponding to said position. In some embodiments, a catalytically inactive Cas9 protein, e.g., dCas9, comprises a D10 mutation (e.g., D10A), a D839 mutation (e.g., D839A), a H840 mutation (e.g., H840A), and a N863 mutation (e.g., N863A) or analogous substitutions to the amino acids corresponding to said positions.

In some embodiments, a catalytically inactive Cas9 protein, e.g., dCas9, or partially deactivated Cas9 protein comprises a E993 mutation (e.g., a E993A mutation) or an analogous substitution to the amino acid corresponding to said position.

In some embodiments, a catalytically inactive Cas9 protein, e.g., dCas9, or partially deactivated Cas9 protein comprises a D917 mutation (e.g., a D917A mutation) or an analogous substitution to the amino acid corresponding to said position. In some embodiments, a catalytically inactive Cas9 protein, e.g., dCas9, or partially deactivated Cas9 protein comprises a a E1006 mutation (e.g., a E1006A mutation) or an analogous substitution to the amino acid corresponding to said position. In some embodiments, a catalytically inactive Cas9 protein, e.g., dCas9, or partially deactivated Cas9 protein comprises a D1255 mutation (e.g., a D1255A mutation) or an analogous substitution to the amino acid corresponding to said position. In some embodiments, a catalytically inactive Cas9 protein, e.g., dCas9, comprises a D917 mutation (e.g., D917A), a E1006 mutation (e.g., E1006A), and a D1255 mutation (e.g., D1255A) or analogous substitutions to the amino acids corresponding to said positions.

In some embodiments, a catalytically inactive Cas9 protein, e.g., dCas9, or partially deactivated Cas9 protein comprises a D16 mutation (e.g., a D16A mutation) or an analogous substitution to the amino acid corresponding to said position. In some embodiments, a catalytically inactive Cas9 protein, e.g., dCas9, or partially deactivated Cas9 protein comprises a D587 mutation (e.g., a D587A mutation) or an analogous substitution to the amino acid corresponding to said position. In some embodiments, a partially deactivated Cas domain has nickase activity. In some embodiments, a partially deactivated Cas9 domain is a Cas9 nickase domain. In some embodiments, the catalytically inactive Cas domain or dead Cas domain produces no detectable double strand break formation. In some embodiments, a catalytically inactive Cas9 protein, e.g., dCas9, or partially deactivated Cas9 protein comprises a H588 mutation (e.g., a H588A mutation) or an analogous substitution to the amino acid corresponding to said position. In some embodiments, a catalytically inactive Cas9 protein, e.g., dCas9, or partially deactivated Cas9 protein comprises a N611 mutation (e.g., a N611A mutation) or an analogous substitution to the amino acid corresponding to said position. In some embodiments, a catalytically inactive Cas9 protein, e.g., dCas9, comprises a D16 mutation (e.g., D16A), a D587 mutation (e.g., D587A), a H588 mutation (e.g., H588A), and a N611 mutation (e.g., N611A) or analogous substitutions to the amino acids corresponding to said positions.

In some embodiments, a DNA-binding domain or endonuclease domain may comprise a Cas molecule comprising or linked (e.g., covalently) to a gRNA (e.g., a template nucleic acid, e.g., template RNA, comprising a gRNA).

In some embodiments, an endonuclease domain or DNA binding domain comprises a *Streptococcus pyogenes* Cas9 (SpCas9) or a functional fragment or variant thereof. In some embodiments, the endonuclease domain or DNA binding domain comprises a modified SpCas9. In embodiments, the modified SpCas9 comprises a modification that alters protospacer-adjacent motif (PAM) specificity. In embodiments, the PAM has specificity for the nucleic acid sequence 5'-NGT-3'. In embodiments, the modified SpCas9 comprises one or more amino acid substitutions, e.g., at one or more of positions L1111, D1135, G1218, E1219, A1322, of R1335, e.g., selected from L1111R, D1135V, G1218R, E1219F, A1322R, R1335V. In embodiments, the modified SpCas9 comprises the amino acid substitution T1337R and one or more additional amino acid substitutions, e.g., selected from L1111, D1135L, S1136R, G1218S, E1219V, D1332A, D1332S, D1332T, D1332V, D1332L, D1332K, D1332R, R1335Q, T1337, T1337L, T1337Q, T1337I, T1337V, T1337F, T1337S, T1337N, T1337K, T1337H, T1337Q, and T1337M, or corresponding amino acid substitutions thereto. In embodiments, the modified SpCas9 comprises: (i) one or more amino acid substitutions selected from D1135L, S1136R, G1218S, E1219V, A1322R, R1335Q, and T1337; and (ii) one or more amino acid substitutions selected from L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereto.

In some embodiments, the endonuclease domain or DNA binding domain comprises a Cas domain, e.g., a Cas9 domain. In embodiments, the endonuclease domain or DNA binding domain comprises a nuclease-active Cas domain, a Cas nickase (nCas) domain, or a nuclease-inactive Cas (dCas) domain. In embodiments, the endonuclease domain or DNA binding domain comprises a nuclease-active Cas9 domain, a Cas9 nickase (nCas9) domain, or a nuclease-inactive Cas9 (dCas9) domain. In some embodiments, the endonuclease domain or DNA binding domain comprises a Cas9 domain of Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises a Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises an *S. pyogenes* or an *S. thermophilus* Cas9, or a functional fragment thereof. In some embodiments, the endonuclease domain or DNA binding domain comprises a Cas9 sequence, e.g., as described in Chylinski, Rhun, and Charpentier (2013) RNA Biology 10:5, 726-737; incorporated herein by reference. In some embodiments, the endonuclease domain or DNA binding domain comprises the HNH nuclease subdomain and/or the RuvC1 subdomain of a Cas, e.g., Cas9, e.g., as described herein, or a variant thereof. In some embodiments, the endonuclease domain or DNA binding domain comprises Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises a Cas polypeptide (e.g., enzyme), or a functional fragment thereof. In embodiments, the Cas polypeptide (e.g., enzyme) is selected from Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (e.g., Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, Cpf1, Cas12b/C2c1, Cas12c/C2c3, Cas12b/C2c1, Cas12c/C2c3, SpCas9 (K855A), eSpCas9(1.1), SpCas9-HF1, hyper accurate Cas9 variant (HypaCas9), homologues thereof, modified or engineered versions thereof, and/or functional fragments thereof. In embodiments, the Cas9 comprises one or more substitutions, e.g., selected from H840A, D10A, P475A, W476A, N477A, D1125A, W1126A, and D1127A. In embodiments, the Cas9 comprises one or more mutations at positions selected from: D10, G12, G17, E762, H840, N854, N863, H982, H983, A984, D986, and/or A987, e.g., one or more substitutions selected from D10A, G12A, G17A, E762A, H840A, N854A, N863A, H982A, H983A, A984A, and/or D986A. In some embodiments, the endonuclease domain or DNA binding domain comprises a Cas (e.g., Cas9) sequence from *Corynebacterium ulcerans, Corynebacterium diphtheria, Spiroplasma syrphidicola, Prevotella intermedia, Spiroplasma taiwanense, Streptococcus iniae, Belliella baltica, Psychroflexus torquis, Streptococcus thermophilus, Listeria innocua, Campylobacter jejuni, Neisseria meningitidis, Streptococcus pyogenes,* or *Staphylococcus aureus,* or a fragment or variant thereof.

In some embodiments, the endonuclease domain or DNA binding domain comprises a Cpf1 domain, e.g., comprising one or more substitutions, e.g., at position D917, E1006A, D1255 or any combination thereof, e.g., selected from D917A, E1006A, D1255A, D917A/E1006A, D917A/D1255A, E1006A/D1255A, and D917A/E1006A/D1255A.

In some embodiments, the endonuclease domain or DNA binding domain comprises spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a gene modifying polypeptide has an endonuclease domain comprising a Cas9 nickase, e.g., Cas9 H840A. In embodiments, the Cas9 H840A has the following amino acid sequence:

Cas9 nickase (H840A):
(SEQ ID NO: 11,001)
DKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNA
SLGTYHDLLKIIKDKDFLNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS DYDVDAIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGD In some embodiments, a gene modifying polypeptide comprises a dCas9 sequence comprising a D10A and/or H840A mutation, e.g., the following sequence:

(SEQ ID NO: 5007)
SMDKKYSIGLAIGTNSVGWAVITDDYKVPSKKFKVLGNTDRHSIKKNLI
GALLFDSGETAEATRLKRTARRRYTRRKNRICYLQEIFSNEMAKVDDSF
FHRLEESFLVEEDKKHERHPIFGNIVDEVAYHEKYPTIYHLRKKLVDST
DKADLRLIYLALAHMIKFRGHFLIEGDLNPDNSDVDKLFIQLVQTYNQL
FEENPINASGVDAKAILSARLSKSRRLENLIAQLPGEKKNGLFGNLIAL
SLGLTPNFKSNFDLAEDAKLQLSKDTYDDDLDNLLAQIGDQYADLFLAA
KNLSDAILLSDILRVNTEITKAPLSASMIKRYDEHHQDLTLLKALVRQQ
LPEKYKEIFFDQSKNGYAGYIDGGASQEEFYKFIKPILEKMDGTEELLV
KLNREDLLRKQRTFDNGSIPHQIHLGELHAILRRQEDFYPFLKDNREKI
EKILTFRIPYYVGPLARGNSRFAWMTRKSEETITPWNFEEVVDKGASAQ
SFIERMTNFDKNLPNEKVLPKHSLLYEYFTVYNELTKVKYVTEGMRKPA
FLSGEQKKAIVDLLFKTNRKVTVKQLKEDYFKKIECFDSVEISGVEDRF
NASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKS
DGFANRNFMQLIHDDSLTFKEDIQKAQVSGQGDSLHEHIANLAGSPAIK
KGILQTVKVVDELVKVMGRHKPENIVIEMARENQTTQKGQKNSRERMKR
IEEGIKELGSQILKEHPVENTQLQNEKLYLYYLQNGRDMYVDQELDINR
LSDYDVDAIVPQSFLKDDSIDNKVLTRSDKNRGKSDNVPSEEVVKKMKN
YWRQLLNAKLITQRKFDNLTKAERGGLSELDKAGFIKRQLVETRQITKH
VAQILDSRMNTKYDENDKLIREVKVITLKSKLVSDFRKDFQFYKVREIN
NYHHAHDAYLNAVVGTALIKKYPKLESEFVYGDYKVYDVRKMIAKSEQE
IGKATAKYFFYSNIMNFFKTEITLANGEIRKRPLIETNGETGEIVWDKG
RDFATVRKVLSMPQVNIVKKTEVQTGGFSKESILPKRNSDKLIARKKDW
DPKKYGGFDSPTVAYSVLVVAKVEKGKSKKLKSVKELLGITIMERSSFE
KNPIDFLEAKGYKEVKKDLIIKLPKYSLFELENGRKRMLASAGELQKGN
ELALPSKYVNFLYLASHYEKLKGSPEDNEQKQLFVEQHKYLDEIIEQI

-continued

SEFSKRVILADANLDKVLSAYNKHRDKPIREQAENIIHLFTLTNLGAPA

AFKYFDTTIDRKRYTSTKEVLDATLIHQSITGLYETRIDLSQLGGD

TAL Effectors and Zinc Finger Nucleases

In some embodiments, an endonuclease domain or DNA-binding domain comprises a TAL effector molecule. A TAL effector molecule, e.g., a TAL effector molecule that specifically binds a DNA sequence, typically comprises a plurality of TAL effector domains or fragments thereof, and optionally one or more additional portions of naturally occurring TAL effectors (e.g., N- and/or C-terminal of the plurality of TAL effector domains). Many TAL effectors are known to those of skill in the art and are commercially available, e.g., from Thermo Fisher Scientific.

Naturally occurring TALEs are natural effector proteins secreted by numerous species of bacterial pathogens including the plant pathogen *Xanthomonas* which modulates gene expression in host plants and facilitates bacterial colonization and survival. The specific binding of TAL effectors is based on a central repeat domain of tandemly arranged nearly identical repeats of typically 33 or 34 amino acids (the repeat-variable di-residues, RVD domain).

Members of the TAL effectors family differ mainly in the number and order of their repeats. The number of repeats typically ranges from 1.5 to 33.5 repeats and the C-terminal repeat is usually shorter in length (e.g., about 20 amino acids) and is generally referred to as a "half-repeat." Each repeat of the TAL effector generally features a one-repeat-to-one-base-pair correlation with different repeat types exhibiting different base-pair specificity (one repeat recognizes one base-pair on the target gene sequence). Generally, the smaller the number of repeats, the weaker the protein-DNA interactions. A number of 6.5 repeats has been shown to be sufficient to activate transcription of a reporter gene (Scholze et al., 2010).

Repeat to repeat variations occur predominantly at amino acid positions 12 and 13, which have therefore been termed "hypervariable" and which are responsible for the specificity of the interaction with the target DNA promoter sequence, as shown in Table 9 listing exemplary repeat variable diresidues (RVD) and their correspondence to nucleic acid base targets.

cies such as the African strain of *Xanthomonas oryzae* pv. *Oryzae* (Yu et al. 2011), *Xanthomonas campestris* pv. *raphani* strain 756C and *Xanthomonas oryzae* pv. *oryzicola* strain BLS256 (Bogdanove et al. 2011). In some embodiments, the TAL effector domain comprises an RVD domain as well as flanking sequence(s) (sequences on the N-terminal and/or C-terminal side of the RVD domain) also from the naturally occurring TAL effector. It may comprise more or fewer repeats than the RVD of the naturally occurring TAL effector. The TAL effector molecule can be designed to target a given DNA sequence based on the above code and others known in the art. The number of TAL effector domains (e.g., repeats (monomers or modules)) and their specific sequence can be selected based on the desired DNA target sequence. For example, TAL effector domains, e.g., repeats, may be removed or added in order to suit a specific target sequence. In an embodiment, the TAL effector molecule of the present invention comprises between 6.5 and 33.5 TAL effector domains, e.g., repeats. In an embodiment, TAL effector molecule of the present invention comprises between 8 and 33.5 TAL effector domains, e.g., repeats, e.g., between 10 and 25 TAL effector domains, e.g., repeats, e.g., between 10 and 14 TAL effector domains, e.g., repeats.

In some embodiments, the TAL effector molecule comprises TAL effector domains that correspond to a perfect match to the DNA target sequence. In some embodiments, a mismatch between a repeat and a target base-pair on the DNA target sequence is permitted as along as it allows for the function of the polypeptide comprising the TAL effector molecule. In general, TALE binding is inversely correlated with the number of mismatches. In some embodiments, the TAL effector molecule of a polypeptide of the present invention comprises no more than 7 mismatches, 6 mismatches, 5 mismatches, 4 mismatches, 3 mismatches, 2 mismatches, or 1 mismatch, and optionally no mismatch, with the target DNA sequence. Without wishing to be bound by theory, in general the smaller the number of TAL effector domains in the TAL effector molecule, the smaller the number of mismatches will be tolerated and still allow for the function of the polypeptide comprising the TAL effector molecule. The binding affinity is thought to depend on the sum of matching repeat-DNA combinations. For example,

TABLE 9

RVDs and Nucleic Acid Base Specificity

| Target | Possible RVD Amino Acid Combinations | | | | | | | | | | | | |
|---|---|---|---|---|---|---|---|---|---|---|---|---|---|
| A | NI | NN | CI | HI | KI | | | | | | | | |
| G | NN | GN | SN | VN | LN | DN | QN | EN | HN | RH | NK | AN | FN |
| C | HD | RD | KD | ND | AD | | | | | | | | |
| T | NG | HG | VG | IG | EG | MG | YG | AA | EP | VA | QG | KG | RG |

Accordingly, it is possible to modify the repeats of a TAL effector to target specific DNA sequences. Further studies have shown that the RVD NK can target G. Target sites of TAL effectors also tend to include a T flanking the 5' base targeted by the first repeat, but the exact mechanism of this recognition is not known. More than 113 TAL effector sequences are known to date. Non-limiting examples of TAL effectors from *Xanthomonas* include, Hax2, Hax3, Hax4, AvrXa7, AvrXa10 and AvrBs3.

Accordingly, the TAL effector domain of a TAL effector molecule described herein may be derived from a TAL effector from any bacterial species (e.g., *Xanthomonas* spe- TAL effector molecules having 25 TAL effector domains or more may be able to tolerate up to 7 mismatches.

In addition to the TAL effector domains, the TAL effector molecule of the present invention may comprise additional sequences derived from a naturally occurring TAL effector. The length of the C-terminal and/or N-terminal sequence(s) included on each side of the TAL effector domain portion of the TAL effector molecule can vary and be selected by one skilled in the art, for example based on the studies of Zhang et al. (2011). Zhang et al., have characterized a number of C-terminal and N-terminal truncation mutants in Hax3 derived TAL-effector based proteins and have identified key elements, which contribute to optimal binding to the target sequence and thus activation of transcription. Generally, it was found that transcriptional activity is inversely correlated with the length of N-terminus. Regarding the C-terminus, an important element for DNA binding residues within the first 68 amino acids of the Hax 3 sequence was identified. Accordingly, in some embodiments, the first 68 amino acids on the C-terminal side of the TAL effector domains of the naturally occurring TAL effector is included in the TAL effector molecule. Accordingly, in an embodiment, a TAL effector molecule comprises 1) one or more TAL effector domains derived from a naturally occurring TAL effector; 2) at least 70, 80, 90, 100, 110, 120, 130, 140, 150, 170, 180, 190, 200, 220, 230, 240, 250, 260, 270, 280 or more amino acids from the naturally occurring TAL effector on the N-terminal side of the TAL effector domains; and/or 3) at least 68, 80, 90, 100, 110, 120, 130, 140, 150, 170, 180, 190, 200, 220, 230, 240, 250, 260 or more amino acids from the naturally occurring TAL effector on the C-terminal side of the TAL effector domains.

In some embodiments, an endonuclease domain or DNA-binding domain is or comprises a Zn finger molecule. A Zn finger molecule comprises a Zn finger protein, e.g., a naturally occurring Zn finger protein or engineered Zn finger protein, or fragment thereof. Many Zn finger proteins are known to those of skill in the art and are commercially available, e.g., from Sigma-Aldrich.

In some embodiments, a Zn finger molecule comprises a non-naturally occurring Zn finger protein that is engineered to bind to a target DNA sequence of choice. See, for example, Beerli, et al. (2002) Nature Biotechnol. 20:135-141; Pabo, et al. (2001) Ann. Rev. Biochem. 70:313-340; Isalan, et al. (2001) Nature Biotechnol. 19:656-660; Segal, et al. (2001) Curr. Opin. Biotechnol. 12:632-637; Choo, et al. (2000) Curr. Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered Zn finger protein may have a novel binding specificity, compared to a naturally-occurring Zn finger protein. Engineering methods include, but are not limited to, rational design and various types of selection. Rational design includes, for example, using databases comprising triplet (or quadruplet) nucleotide sequences and individual Zn finger amino acid sequences, in which each triplet or quadruplet nucleotide sequence is associated with one or more amino acid sequences of zinc fingers which bind the particular triplet or quadruplet sequence. See, for example, U.S. Pat. Nos. 6,453,242 and 6,534,261, incorporated by reference herein in their entireties.

Exemplary selection methods, including phage display and two-hybrid systems, are disclosed in U.S. Pat. Nos. 5,789,538; 5,925,523; 6,007,988; 6,013,453; 6,410,248; 6,140,466; 6,200,759; and 6,242,568; as well as International Patent Publication Nos. WO 98/37186; WO 98/53057; WO 00/27878; and WO 01/88197 and GB 2,338,237. In addition, enhancement of binding specificity for zinc finger proteins has been described, for example, in International Patent Publication No. WO 02/077227.

In addition, as disclosed in these and other references, zinc finger domains and/or multi-fingered zinc finger proteins may be linked together using any suitable linker sequences, including, for example, linkers of 5 or more amino acids in length. See, also, U.S. Pat. Nos. 6,479,626; 6,903,185; and 7,153,949 for exemplary linker sequences 6 or more amino acids in length. The proteins described herein may include any combination of suitable linkers between the individual zinc fingers of the protein. In addition, enhancement of binding specificity for zinc finger binding domains has been described, for example, in co-owned International Patent Publication No. WO 02/077227.

Zn finger proteins and methods for design and construction of fusion proteins (and polynucleotides encoding same) are known to those of skill in the art and described in detail in U.S. Pat. Nos. 6,140,081; 5,789,538; 6,453,242; 6,534,261; 5,925,523; 6,007,988; 6,013,453; and 6,200,759; International Patent Publication Nos. WO 95/19431; WO 96/06166; WO 98/53057; WO 98/54311; WO 00/27878; WO 01/60970; WO 01/88197; WO 02/099084; WO 98/53058; WO 98/53059; WO 98/53060; WO 02/016536; and WO 03/016496.

In addition, as disclosed in these and other references, Zn finger proteins and/or multi-fingered Zn finger proteins may be linked together, e.g., as a fusion protein, using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The Zn finger molecules described herein may include any combination of suitable linkers between the individual zinc finger proteins and/or multi-fingered Zn finger proteins of the Zn finger molecule.

In certain embodiments, the DNA-binding domain or endonuclease domain comprises a Zn finger molecule comprising an engineered zinc finger protein that binds (in a sequence-specific manner) to a target DNA sequence. In some embodiments, the Zn finger molecule comprises one Zn finger protein or fragment thereof. In other embodiments, the Zn finger molecule comprises a plurality of Zn finger proteins (or fragments thereof), e.g., 2, 3, 4, 5, 6 or more Zn finger proteins (and optionally no more than 12, 11, 10, 9, 8, 7, 6, 5, 4, 3, or 2 Zn finger proteins). In some embodiments, the Zn finger molecule comprises at least three Zn finger proteins. In some embodiments, the Zn finger molecule comprises four, five or six fingers. In some embodiments, the Zn finger molecule comprises 8, 9, 10, 11 or 12 fingers. In some embodiments, a Zn finger molecule comprising three Zn finger proteins recognizes a target DNA sequence comprising 9 or 10 nucleotides. In some embodiments, a Zn finger molecule comprising four Zn finger proteins recognizes a target DNA sequence comprising 12 to 14 nucleotides. In some embodiments, a Zn finger molecule comprising six Zn finger proteins recognizes a target DNA sequence comprising 18 to 21 nucleotides.

In some embodiments, a Zn finger molecule comprises a two-handed Zn finger protein. Two handed zinc finger proteins are those proteins in which two clusters of zinc finger proteins are separated by intervening amino acids so that the two zinc finger domains bind to two discontinuous target DNA sequences. An example of a two handed type of zinc finger binding protein is SIP1, where a cluster of four zinc finger proteins is located at the amino terminus of the protein and a cluster of three Zn finger proteins is located at the carboxyl terminus (see Remade, et al. (1999) EMBO Journal 18(18):5073-5084). Each cluster of zinc fingers in these proteins is able to bind to a unique target sequence and the spacing between the two target sequences can comprise many nucleotides.

Linkers

In some embodiments, a gene modifying polypeptide may comprise a linker, e.g., a peptide linker, e.g., a linker as described in Table 1 or Table 10. In some embodiments, a gene modifying polypeptide comprises, in an N-terminal to C-terminal direction, a Cas domain (e.g., a Cas domain of Table 8), a linker of Table 10 (or a sequence having at least 70%, 75%, 80%, 85%, 90%, 95%, or 99% identity thereto), and an RT domain (e.g., an RT domain of Table 6). In some embodiments, a gene modifying polypeptide comprises a flexible linker between the endonuclease and the RT domain, e.g., a linker comprising the amino acid sequence SGGSSGGSSGSETPGTSESATPESSGGSSGGSS (SEQ ID NO: 11,002). In some embodiments, an RT domain of a gene modifying polypeptide may be located C-terminal to the endonuclease domain. In some embodiments, an RT domain of a gene modifying polypeptide may be located N-terminal to the endonuclease domain. In some embodiments, a gene modifying polypeptide comprises an amino acid sequence as listed in Table A1, or or a sequence having at least 70%, 75%, 80%, 85%, 90%, 95%, or 99% identity thereto.

TABLE 10

Exemplary linker sequences

| Amino Acid Sequence | SEQ ID NO |
|---|---|
| GGS | |
| GGSGGS | 5102 |
| GGSGGSGGS | 5103 |
| GGSGGSGGSGGS | 5104 |
| GGSGGSGGSGGSGGS | 5105 |
| GGSGGSGGSGGSGGSGGS | 5106 |
| GGGGS | 5107 |
| GGGGSGGGGS | 5108 |
| GGGGSGGGGSGGGGS | 5109 |
| GGGGSGGGGSGGGGSGGGGS | 5110 |
| GGGGSGGGGSGGGGSGGGGSGGGGS | 5111 |
| GGGGSGGGGSGGGGSGGGGSGGGGSGGGGS | 5112 |
| GGG | |
| GGGG | 5114 |
| GGGGG | 5115 |
| GGGGGG | 5116 |
| GGGGGGG | 5117 |
| GGGGGGGG | 5118 |
| GSS | |
| GSSGSS | 5120 |
| GSSGSSGSS | 5121 |
| GSSGSSGSSGSS | 5122 |
| GSSGSSGSSGSSGSS | 5123 |
| GSSGSSGSSGSSGSSGSS | 5124 |
| EAAAK | 5125 |
| EAAAKEAAAK | 5126 |

TABLE 10-continued

Exemplary linker sequences

| Amino Acid Sequence | SEQ ID NO |
|---|---|
| EAAAKEAAAKEAAAK | 5127 |
| EAAAKEAAAKEAAAKEAAAK | 5128 |
| EAAAKEAAAKEAAAKEAAAKEAAAK | 5129 |
| EAAAKEAAAKEAAAKEAAAKEAAAKEAAAK | 5130 |
| PAP | |
| PAPAP | 5132 |
| PAPAPAP | 5133 |
| PAPAPAPAP | 5134 |
| PAPAPAPAPAP | 5135 |
| PAPAPAPAPAPAP | 5136 |
| GGSGGG | 5137 |
| GGGGGS | 5138 |
| GGSGSS | 5139 |
| GSSGGS | 5140 |
| GGSEAAAK | 5141 |
| EAAAKGGS | 5142 |
| GGSPAP | 5143 |
| PAPGGS | 5144 |
| GGGGSS | 5145 |
| GSSGGG | 5146 |
| GGGEAAAK | 5147 |
| EAAAKGGG | 5148 |
| GGGPAP | 5149 |
| PAPGGG | 5150 |
| GSSEAAAK | 5151 |
| EAAAKGSS | 5152 |
| GSSPAP | 5153 |
| PAPGSS | 5154 |
| EAAAKPAP | 5155 |
| PAPEAAAK | 5156 |
| GGSGGGGSS | 5157 |
| GGSGSSGGG | 5158 |
| GGGGGSGSS | 5159 |
| GGGGSSGGS | 5160 |
| GSSGGSGGG | 5161 |
| GSSGGGGGS | 5162 |
| GGSGGGEAAAK | 5163 |

TABLE 10-continued

Exemplary linker sequences

| Amino Acid Sequence | SEQ ID NO |
|---|---|
| GGSEAAAKGGG | 5164 |
| GGGGGSEAAAK | 5165 |
| GGGEAAAKGGS | 5166 |
| EAAAKGGSGGG | 5167 |
| EAAAKGGGGGS | 5168 |
| GGSGGGPAP | 5169 |
| GGSPAPGGG | 5170 |
| GGGGGSPAP | 5171 |
| GGGPAPGGS | 5172 |
| PAPGGSGGG | 5173 |
| PAPGGGGGS | 5174 |
| GGSGSSEAAAK | 5175 |
| GGSEAAAKGSS | 5176 |
| GSSGGSEAAAK | 5177 |
| GSSEAAAKGGS | 5178 |
| EAAAKGGSGSS | 5179 |
| EAAAKGSSGGS | 5180 |
| GGSGSSPAP | 5181 |
| GGSPAPGSS | 5182 |
| GSSGGSPAP | 5183 |
| GSSPAPGGS | 5184 |
| PAPGGSGSS | 5185 |
| PAPGSSGGS | 5186 |
| GGSEAAAKPAP | 5187 |
| GGSPAPEAAAK | 5188 |
| EAAAKGGSPAP | 5189 |
| EAAAKPAPGGS | 5190 |
| PAPGGSEAAAK | 5191 |
| PAPEAAAKGGS | 5192 |
| GGGGSSEAAAK | 5193 |
| GGGEAAAKGSS | 5194 |
| GSSGGGEAAAK | 5195 |
| GSSEAAAKGGG | 5196 |
| EAAAKGGGGSS | 5197 |
| EAAAKGSSGGG | 5198 |
| GGGGSSPAP | 5199 |
| GGGPAPGSS | 5200 |
| GSSGGGPAP | 5201 |

TABLE 10-continued

Exemplary linker sequences

| Amino Acid Sequence | SEQ ID NO |
|---|---|
| GSSPAPGGG | 5202 |
| PAPGGGGSS | 5203 |
| PAPGSSGGG | 5204 |
| GGGEAAAKPAP | 5205 |
| GGGPAPEAAAK | 5206 |
| EAAAKGGGPAP | 5207 |
| EAAAKPAPGGG | 5208 |
| PAPGGGEAAAK | 5209 |
| PAPEAAAKGGG | 5210 |
| GSSEAAAKPAP | 5211 |
| GSSPAPEAAAK | 5212 |
| EAAAKGSSPAP | 5213 |
| EAAAKPAPGSS | 5214 |
| PAPGSSEAAAK | 5215 |
| PAPEAAAKGSS | 5216 |
| AEAAAKEAAAKEAAAKEAAAKALEAEAAAKEAAAKEAAAKEAAAKA | 5217 |
| GGGGSEAAAKGGGGS | 5218 |
| EAAAKGGGGSEAAAK | 5219 |
| SGSETPGTSESATPES | 5220 |
| GSAGSAAGSGEF | 5221 |
| SGGSSGGSSGSETPGTSESATPESSGGSSGGSS | 5222 |

In some embodiments, a linker of a gene modifying polypeptide comprises a motif chosen from: $(SGGS)_n$ (SEQ ID NO: 5025), $(GGGS)_a$ (SEQ ID NO: 5026), $(GGGGS)_n$ (SEQ ID NO: 5027), $(G)_n$, $(EAAAK)_n$ (SEQ ID NO: 5028), $(GGS)_n$, or $(XP)_n$.

Gene Modifying Polypeptide Selection by Pooled Screening

Candidate gene modifying polypeptides may be screened to evaluate a candidate's gene editing ability. For example, an RNA gene modifying system designed for the targeted editing of a coding sequence in the human genome may be used. In certain embodiments, such a gene modifying system may be used in conjunction with a pooled screening approach.

For example, a library of gene modifying polypeptide candidates and a template guide RNA (tgRNA) may be introduced into mammalian cells to test the candidates' gene editing abilities by a pooled screening approach. In specific embodiments, a library of gene modifying polypeptide candidates is introduced into mammalian cells followed by introduction of the tgRNA into the cells.

Representative, non-limiting examples of mammalian cells that may be used in screening include HEK293T cells, U2OS cells, HeLa cells, HepG2 cells, Huh7 cells, K562 cells, or iPS cells.

A gene modifying polypeptide candidate may comprise 1) a Cas-nuclease, for example a wild-type Cas nuclease, e.g., a wild-type Cas9 nuclease, a mutant Cas nuclease, e.g., a Cas nickase, for example, a Cas9 nickase such as a Cas9 N863A nickase, or a Cas nuclease selected from Table 7 or 8, 2) a peptide linker, e.g., a sequence from Table 1 or 10, that may exhibit varying degrees of length, flexibility, hydrophobicity, and/or secondary structure; and 3) a reverse transcriptase (RT), e.g. an RT domain from Table 1 or 6. A gene modifying polypeptide candidate library comprises: a plurality of different gene modifying polypeptide candidates that differ from each other with respect to one, two or all three of the Cas nuclease, peptide linker or RT domain components, or a plurality of nucleic acid expression vectors that encode such gene modifying polypeptide candidates.

For screening of gene modifying polypeptide candidates, a two-component system may be used that comprises a gene modifying polypeptide component and a tgRNA component. A gene modifying component may comprise, for example, an expression vector, e.g., an expression plasmid or lentiviral vector, that encodes a gene modifying polypeptide candidate, for example, comprises a human codon-optimized nucleic acid that encodes a gene modifying polypeptide candidate, e.g., a Cas-linker-RT fusion as described above. In a particular embodiment, a lentiviral cassette is utilized that comprises: (i) a promoter for expression in mammalian cells, e.g., a CMV promoter; (ii) a gene modifying library candidate, e.g. a Cas-linker-RT fusion comprising a Cas nuclease of Table 7 or 8, a peptide linker of Table 10 and an RT of Table 6, for example a Cas-linker-RT fusion as in Table 1; (iii) a self-cleaving polypeptide, e.g., a T2A peptide; (iv) a marker enabling selection in mammalian cells, e.g., a puromycin resistance gene; and (v) a termination signal, e.g., a poly A tail.

The tgRNA component may comprise a tgRNA or expression vector, e.g., an expression plasmid, that produces the tgRNA, for example, utilizes a U6 promoter to drive expression of the tgRNA, wherein the tgRNA is a non-coding RNA sequence that is recognized by Cas and localizes it to the genomic locus of interest, and that also templates reverse transcription of the desired edit into the genome by the RT domain.

To prepare a pool of cells expressing gene modifying polypeptide library candidates, mammalian cells, e.g., HEK293T or U2OS cells, may be transduced with pooled gene modifying polypeptide candidate expression vector preparations, e.g., lentiviral preparations, of the gene modifying candidate polypeptide library. In a particular embodiment, lentiviral plasmids are utilized, and HEK293 Lenti-X cells are seeded in 15 cm plates (~12×10$^6$ cells) prior to lentiviral plasmid transfection. In such an embodiment, lentiviral plasmid transfection may be performed using the Lentiviral Packaging Mix (Biosettia) and transfection of the plasmid DNA for the gene modifying candidate library is performed the following day using Lipofectamine 2000 and Opti-MEM media according to the manufacturer's protocol. In such an embodiment, extracellular DNA may be removed by a full media change the next day and virus-containing media may be harvested 48 hours after. Lentiviral media may be concentrated using Lenti-X Concentrator (TaKaRa Biosciences) and 5 mL lentiviral aliquots may be made and stored at −80° C. Lentiviral titering is performed by enumerating colony forming units post-selection, e.g., post Puromycin selection.

For monitoring gene editing of a target DNA, mammalian cells, e.g., HEK293T or U2OS cells, carrying a target DNA may be utilized. In other embodiments for monitoring gene editing of a target DNA, mammalian cells, e.g., HEK293T or U2OS cells, carrying a target DNA genomic landing pad may be utilized. In particular embodiments, the target DNA genomic landing pad may comprise a gene to be edited for treatment of a disease or disorder of interest. In other particular embodiments, the target DNA is a gene sequence that expresses a protein that exhibits detectable characteristics that may be monitored to determine whether gene editing has occurred. For example, in certain embodiments, a blue fluorescence protein (BFP)- or green fluorescence protein (GFP)-expressing genomic landing pad is utilized. In certain embodiments, mammalian cells, e.g., HEK293T or U2OS cells, comprising a target DNA, e.g., a target DNA genomic landing pad, are seeded in culture plates at 500×-3000× cells per gene modifying library candidate and transduced at a 0.2-0.3 multiplicity of infection (MOI) to minimize multiple infections per cell. Puromycin (2.5 ug/mL) may be added 48 hours post infection to allow for selection of infected cells. In such an embodiment, cells may be kept under puromycin selection for at least 7 days and then scaled up for tgRNA introduction, e.g., tgRNA electroporation.

To ascertain whether gene editing occurs, mammalian cells containing a target DNA to be edited may be infected with gene modifying polypeptide library candidates then transfected with tgRNA designed for use in editing of the target DNA. Subsequently, the cells may be analyzed to determine whether editing of the target locus has occurred according to the designed outcome, or whether no editing or imperfect editing has occurred, e.g., by using cell sorting and sequence analysis.

In a particular embodiment, to ascertain whether genome editing occurs, BFP- or GFP-expressing mammalian cells, e.g., HEK293T or U2OS cells, may be infected with gene modifying library candidates and then transfected or electroporated with tgRNA plasmid or RNA, e.g., by electroporation of 250,000 cells/well with 200 ng of a tgRNA plasmid designed to convert BFP-to-GFP or GFP-to-BFP, at a cell count ensuring >250×-1000× coverage per library candidate. In such an embodiment, the genome-editing capacity of the various constructs in this assay may be assessed by sorting the cells by Fluorescence-Activated Cell Sorting (FACS) for expression of the color-converted fluorescent protein (FP) at 4-10 days post-electroporation. Cells are sorted and harvested as distinct populations of unedited cells (exhibiting original florescence protein signal), edited cells (exhibiting converted fluorescence protein signal), and imperfect edit (exhibiting no florescence protein signal) cells. A sample of unsorted cells may also be harvested as the input population to determine candidate enrichment during analysis.

To determine which gene modifying library candidates exhibit genome-editing capacity in an assay, genomic DNA (gDNA) is harvested from the sorted cell populations, and analyzed by sequencing the gene modifying library candidates in each population. Briefly, gene modifying candidates may be amplified from the genome using primers specific to the gene modifying polypeptide expression vector, e.g., the lentiviral cassette, amplified in a second round of PCR to dilute genomic DNA, and then sequenced, for example, sequenced by a next-generation sequencing platform. After quality control of sequencing reads, reads of at least about 1500 nucleotides and generally no more than about 3200 nucleotides are mapped to the gene modifying polypeptide library sequences and those containing a minimum of about an 80% match to a library sequence are considered to be successfully aligned to a given candidate for purposes of this pooled screen. In order to identify candidates capable of performing gene editing in the assay, e.g., the BFP-to-GFP or GFP-to-BFP edit, the read count of each library candidate in the edited population is compared to its read count in the initial, unsorted population.

For purposes of pooled screening, gene modifying candidates with genome-editing capacity are identified based on enrichment in the edited (converted FP) population relative to unsorted (input) cells. In some embodiments, an enrichment of at least 1.0, 1.5, 2.0, 2.5, 3.0, 4.0, 5.0, 6.0, 7.0, 8.0, 9.0, 10, 15, 20, 25, 30, 40, 50, 60, 70, 80, 90, or at least 100-fold over the input indicates potentially useful gene editing activity, e.g., at least 2-fold enrichment. In some embodiments, the enrichment is converted to a log-value by taking the log base 2 of the enrichment ratio. In some embodiments, a log 2 enrichment score of at least 0, 1, 2, 3, 4, 5, 5.5, 6.0, 6.2, 6.3, 6.4, 6.5, or at least 6.6 indicates potentially useful gene editing activity, e.g., a log 2 enrichment score of at least 1.0. In particular embodiments, enrichment values observed for gene modifying candidates may be compared to enrichment values observed under similar conditions utilizing a reference, e.g., Element ID No: 17380 as listed in Example 7.

In some embodiments, multiple tgRNAs may be used to screen the gene modifying candidate library. In particular embodiments, a plurality of tgRNAs may be utilized to optimize template/Cas-linker-RT fusion pairs, e.g., for gene editing of particular target genes, for example, gene targets for the treatment of disease. In specific embodiments, a pooled approach to screening gene modifying candidates may be performed using a multiplicity of different tgRNAs in an arrayed format.

In some embodiments, multiple types of edits, e.g., insertions, substitutions, and/or deletions of different lengths, may be used to screen the gene modifying candidate library.

In some embodiments, multiple target sequences, e.g., different fluorescent proteins, may be used to screen the gene modifying candidate library. In some embodiments, multiple target sequences, e.g., different fluorescent proteins, may be used to screen the gene modifying candidate library. In some embodiments, multiple cell types, e.g., HEK293T or U2OS, may be used to screen the gene modifying candidate library. The person of ordinary skill in the art will appreciate that a given candidate may exhibit altered editing capacity or even the gain or loss of any observable or useful activity across different conditions, including tgRNA sequence (e.g., nucleotide modifications, PBS length, RT template length), target sequence, target location, type of edit, location of mutation relative to the first-strand nick of the gene modifying polypeptide, or cell type. Thus, in some embodiments, gene modifying library candidates are screened across multiple parameters, e.g., with at least two distinct tgRNAs in at least two cell types, and gene editing activity is identified by enrichment in any single condition. In other embodiments, a candidate with more robust activity across different tgRNA and cell types is identified by enrichment in at least two conditions, e.g., in all conditions screened. For clarity, candidates found to exhibit little to no enrichment under any given condition are not assumed to be inactive across all conditions and may be screened with different parameters or reconfigured at the polypeptide level, e.g., by swapping, shuffling, or evolving domains (e.g., RT domain), linkers, or other signals (e.g., NLS).

Sequences of Exemplary CAS9-Linker-RT Fusions

In some embodiments, a gene modifying polypeptide comprises a linker sequence and an RT sequence. In some embodiments, a gene modifying polypeptide comprises a linker sequence as listed in Table 1, or an amino acid sequence having at least 75%, 80%, 85%, 90%, 95%, 96%, 97%, 98%, or 99% identity thereto. In some embodiments, a gene modifying polypeptide comprises the amino acid sequence of an RT domain as listed in Table 1, or an amino acid sequence having at least 75%, 80%, 85%, 90%, 95%, 96%, 97%, 98%, or 99% identity thereto. In some embodiments, a gene modifying polypeptide comprises a linker sequence as listed in Table 1, or an amino acid sequence having at least 75%, 80%, 85%, 90%, 95%, 96%, 97%, 98%, or 99% identity thereto; and the amino acid sequence of an RT domain as listed in Table 1, or an amino acid sequence having at least 75%, 80%, 85%, 90%, 95%, 96%, 97%, 98%, or 99% identity thereto. In some embodiments, a gene modifying polypeptide comprises: (i) a linker sequence as listed in a row of Table 1, or an amino acid sequence having at least 75%, 80%, 85%, 90%, 95%, 96%, 97%, 98%, or 99% identity thereto; and (ii) the amino acid sequence of an RT domain as listed in the same row of Table 1, or an amino acid sequence having at least 75%, 80%, 85%, 90%, 95%, 96%, 97%, 98%, or 99% identity thereto.

Exemplary Gene Modifying Polypeptides

In some embodiments, a gene modifying polypeptide (e.g., a gene modifying polypeptide that is part of a system described herein) comprises an amino acid sequence of any one of SEQ ID NOs: 1-7743, or an amino acid sequence having at least 70%, 75%, 80%, 85%, 90%, 95%, or 99% identity thereto. In some embodiments, a gene modifying polypeptide comprises an amino acid sequence of any one of SEQ ID NOs: 1-7743, or an amino acid sequence having at least 80% identity thereto. In some embodiments, a gene modifying polypeptide comprises an amino acid sequence of any one of SEQ ID NOs: 1-7743, or an amino acid sequence having at least 90% identity thereto. In some embodiments, a gene modifying polypeptide comprises an amino acid sequence of any one of SEQ ID NOs: 1-7743, or an amino acid sequence having at least 95% identity thereto. In some embodiments, a gene modifying polypeptide comprises an amino acid sequence of any one of SEQ ID NOs: 1-7743, or an amino acid sequence having at least 99% identity thereto. In some embodiments, a gene modifying polypeptide comprises an amino acid sequence of any one of SEQ ID NOs: 1-7743. In some embodiments, a gene modifying polypeptide comprises an amino acid sequence of any one of SEQ ID NOs: 6001-7743, or an amino acid sequence having at least 70%, 75%, 80%, 85%, 90%, 95%, or 99% identity thereto. In some embodiments, a gene modifying polypeptide comprises an amino acid sequence of any one of SEQ ID NOs: 4501-4541, or an amino acid sequence having at least 70%, 75%, 80%, 85%, 90%, 95%, or 99% identity thereto.

In some embodiments, a gene modifying polypeptide comprises an amino acid sequence as listed in Table A1, or an amino acid sequence having at least 70%, 75%, 80%, 85%, 90%, 95%, or 99% identity thereto.

In some embodiments, a gene modifying polypeptide comprises an amino acid sequence of a SEQ ID NO as listed in Table D1, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D2, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D3, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D4, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D5, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D6, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D7, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D8, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D9, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D10, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D11, or an amino acid sequence having at least 70%, 75%, 80%, 85%, 90%, 95%, or 99% identity thereto. In some embodiments, a gene modifying polypeptide comprises an amino acid sequence of a SEQ ID NO as listed in Table D12, or an amino acid sequence having at least 70%, 75%, 80%, 85%, 90%, 95%, or 99% identity thereto.

In some embodiments, a gene modifying polypeptide comprises an amino acid sequence as listed in Table T1, or an amino acid sequence having at least 70%, 75%, 80%, 85%, 90%, 95%, or 99% identity thereto. In some embodiments, a gene modifying polypeptide comprises a linker comprising a linker sequence as listed in Table T1, or an amino acid sequence having at least 70%, 75%, 80%, 85%, 90%, 95%, or 99% identity thereto. In some embodiments, a gene modifying polypeptide comprises an RT domain comprising an RT domain sequence as listed in Table T1, or an amino acid sequence having at least 70%, 75%, 80%, 85%, 90%, 95%, or 99% identity thereto. In some embodiments, a gene modifying polypeptide comprises: (i) a linker comprising a linker sequence as listed in a row of Table T1, or an amino acid sequence having at least 70%, 75%, 80%, 85%, 90%, 95%, or 99% identity thereto; and (ii) an RT domain comprising an RT domain sequence as listed in the same row of Table T1, or an amino acid sequence having at least 70%, 75%, 80%, 85%, 90%, 95%, or 99% identity thereto.

TABLE T1

Selection of exemplary gene modifying polypeptides

| SEQ ID NO: for Full Polypeptide Sequence | Linker Sequence | SEQ ID NO: of linker | RT name |
| --- | --- | --- | --- |
| 1372 | AEAAAKEAAAKEAAAKEAAAKALEAEAAAKE AAAKEAAAKEAAAKA | 15,401 | AVIRE_P03360_3mutA |
| 1197 | AEAAAKEAAAKEAAAKEAAAKALEAEAAAKE AAAKEAAAKEAAAKA | 15,402 | FLV_P10273_3mutA |
| 2784 | AEAAAKEAAAKEAAAKEAAAKALEAEAAAKE AAAKEAAAKEAAAKA | 15,403 | MLVMS_P03355_3mutA_ WS |
| 647 | AEAAAKEAAAKEAAAKEAAAKALEAEAAAKE AAAKEAAAKEAAAKA | 15,404 | SFV3L_P27401_2mutA |

In some embodiments, a gene modifying polypeptide comprises an amino acid sequence as listed in Table T2, or an amino acid sequence having at least 70%, 75%, 80%, 85%, 90%, 95%, or 99% identity thereto. In some embodiments, a gene modifying polypeptide comprises a linker comprising a linker sequence as listed in Table T2, or an amino acid sequence having at least 70%, 75%, 80%, 85%, 90%, 95%, or 99% identity thereto. In some embodiments, a gene modifying polypeptide comprises an RT domain comprising an RT domain sequence as listed in Table T2, or an amino acid sequence having at least 70%, 75%, 80%, 85%, 90%, 95%, or 99% identity thereto. In some embodiments, a gene modifying polypeptide comprises: (i) a linker comprising a linker sequence as listed in a row of Table T2, or an amino acid sequence having at least 70%, 75%, 80%, 85%, 90%, 95%, or 99% identity thereto; and (ii) an RT domain comprising an RT domain sequence as listed in the same row of Table T2, or an amino acid sequence having at least 70%, 75%, 80%, 85%, 90%, 95%, or 99% identity thereto.

TABLE T2

Selection of exemplary gene modifying polypeptides

| SEQ ID NO: for Full Polypeptide Sequence | Linker Sequence | SEQ ID NO: of linker | RT name |
|---|---|---|---|
| 2311 | GGGGSGGGGSGGGGSGGGGS | 15,405 | MLVCB_P08361_3mutA |
| 1373 | GGGGSGGGGSGGGGSGGGGSGGGGSGGGGS | 15,406 | AVIRE_P03360_3mutA |
| 2644 | GGGGSGGGGSGGGGSGGGGSGGGGSGGGGS | 15,407 | MLVMS_P03355_PLV919 |
| 2304 | GSSGSSGSSGSSGSSGSS | 15,408 | MLVCB_P08361_3mutA |
| 2325 | EAAAKEAAAKEAAAKEAAAK | 15,409 | MLVCB_P08361_3mutA |
| 2322 | EAAAKEAAAKEAAAKEAAAKEAAAKEAAAK | 15,410 | MLVCB_P08361_3mutA |
| 2187 | PAPAPAPAPAP | 15,411 | MLVBM_Q7SVK7_3mut |
| 2309 | PAPAPAPAPAPAP | 15,412 | MLVCB_P08361_3mutA |
| 2534 | PAPAPAPAPAPAP | 15,413 | MLVFF_P26809_3mutA |
| 2797 | PAPAPAPAPAPAP | 15,414 | MLVMS_P03355_3mutA_WS |
| 3084 | PAPAPAPAPAPAP | 15,415 | MLVMS_P03355_3mutA_WS |
| 2868 | PAPAPAPAPAPAP | 15,416 | MLVMS_P03355_PLV919 |
| 126 | EAAAKGGG | 15,417 | PERV_Q4VFZ2_3mut |
| 306 | EAAAKGGG | 15,418 | PERV_Q4VFZ2_3mut |
| 1410 | PAPGGG | 15,419 | AVIRE_P03360_3mutA |
| 804 | GGGGSSGGS | 15,420 | WMSV_P03359_3mut |
| 1937 | GGGGGSEAAAK | 15,421 | BAEVM_P10272_3mutA |
| 2721 | GGGEAAAKGGS | 15,422 | MLVMS_P03355_3mut |
| 3018 | GGGEAAAKGGS | 15,423 | MLVMS_P03355_3mut |
| 1018 | GGGEAAAKGGS | 15,424 | XMRV6_A1Z651_3mutA |
| 2317 | GGSGGGPAP | 15,425 | MLVCB_P08361_3mutA |
| 2649 | PAPGGSGGG | 15,426 | MLVMS_P03355_PLV919 |
| 2878 | PAPGGSGGG | 15,427 | MLVMS_P03355_PLV919 |
| 912 | GGSEAAAKPAP | 15,428 | WMSV_P03359_3mutA |
| 2338 | GGSPAPEAAAK | 15,429 | MLVCB_P08361_3mutA |
| 2527 | GGSPAPEAAAK | 15,430 | MLVFF_P26809_3mutA |
| 141 | EAAAKGGSPAP | 15,431 | PERV_Q4VFZ2_3mut |
| 341 | EAAAKGGSPAP | 15,432 | PERV_Q4VFZ2_3mut |
| 2315 | EAAAKPAPGGS | 15,433 | MLVCB_P08361_3mutA |
| 3080 | EAAAKPAPGGS | 15,434 | MLVMS_P03355_3mutA_WS |
| 2688 | GGGGSSEAAAK | 15,435 | MLVMS_P03355_PLV919 |
| 2885 | GGGGSSEAAAK | 15,436 | MLVMS_P03355_PLV919 |
| 2810 | GSSGGGEAAAK | 15,437 | MLVMS_P03355_3mutA_WS |
| 3057 | GSSGGGEAAAK | 15,438 | MLVMS_P03355_3mutA_WS |

TABLE T2-continued

Selection of exemplary gene modifying polypeptides

| SEQ ID NO: for Full Polypeptide Sequence | Linker Sequence | SEQ ID NO: of linker | RT name |
|---|---|---|---|
| 1861 | GSSEAAAKGGG | 15,439 | MLVAV_P03356_3mutA |
| 3056 | GSSGGGPAP | 15,440 | MLVMS_P03355_3mutA_WS |
| 1038 | GSSPAPGGG | 15,441 | XMRV6_A1Z651_3mutA |
| 2308 | PAPGGGGSS | 15,442 | MLVCB_P08361_3mutA |
| 1672 | GGGEAAAKPAP | 15,443 | KORV_Q9TTC1-Pro_3mutA |
| 2526 | GGGEAAAKPAP | 15,444 | MLVFF_P26809_3mutA |
| 1938 | GGGPAPEAAAK | 15,445 | BAEVM_P10272_3mutA |
| 2641 | GSSEAAAKPAP | 15,446 | MLVMS_P03355_PLV919 |
| 2891 | GSSEAAAKPAP | 15,447 | MLVMS_P03355_PLV919 |
| 1225 | GSSPAPEAAAK | 15,448 | FLV_P10273_3mutA |
| 2839 | GSSPAPEAAAK | 15,449 | MLVMS_P03355_3mutA_WS |
| 3127 | GSSPAPEAAAK | 15,450 | MLVMS_P03355_3mutA_WS |
| 2798 | PAPGSSEAAAK | 15,451 | MLVMS_P03355_3mutA_WS |
| 3091 | PAPGSSEAAAK | 15,452 | MLVMS_P03355_3mutA_WS |
| 1372 | AEAAAKEAAAKEAAAKEAAAKALEAEAAAKEAAAKEAAAKEAAAKA | 15,453 | AVIRE_P03360_3mutA_ |
| 1197 | AEAAAKEAAAKEAAAKEAAAKALEAEAAAKEAAAKEAAAKEAAAKA | 15,454 | FLV_P10273_3mutA |
| 2611 | AEAAAKEAAAKEAAAKEAAAKALEAEAAAKEAAAKEAAAKEAAAKA | 15,455 | MLVMS_P03355_PLV919 |
| 2784 | AEAAAKEAAAKEAAAKEAAAKALEAEAAAKEAAAKEAAAKEAAAKA | 15,456 | MLVMS_P03355_3mutA_WS |
| 480 | AEAAAKEAAAKEAAAKEAAAKALEAEAAAKEAAAKEAAAKEAAAKA | 15,457 | SFV1_P23074_2mutA |
| 647 | AEAAAKEAAAKEAAAKEAAAKALEAEAAAKEAAAKEAAAKEAAAKA | 15,458 | SFV3L_P27401_2mutA |
| 1006 | AEAAAKEAAAKEAAAKEAAAKALEAEAAAKEAAAKEAAAKEAAAKA | 15,459 | XMRV6_A1Z651_3mutA |
| 2518 | SGSETPGTSESATPES | 15,460 | MLVFF_P26809_3mutA |

Subsequences of Exemplary Gene Modifying Polypeptides

In some embodiments, the gene modifying polypeptide comprises, in N-terminal to C-terminal order, one or more (e.g., 1, 2, 3, 4, 5, or all 6) of an N-terminal methionine residue, a first nuclear localization signal (NLS), a DNA binding domain, a linker, an RT domain, and/or a second NLS. In some embodiments, a gene modifying polypeptide comprises, in N-terminal to C-terminal order, a NLS (e.g., a first NLS), a DNA binding domain, a linker, and an RT domain, wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, a gene modifying polypeptide comprises, in N-terminal to C-terminal order, a DNA binding domain, a linker, an RT domain, and an NLS (e.g., a second NLS) wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, a gene modifying polypeptide comprises, in N-terminal to C-terminal order, a first NLS, a DNA binding domain, a linker, an RT domain, and a second NLS, wherein the linker and RT domain are the linker and RT domain of a gene modifying polypeptide of any one of SEQ ID NOs: 1-7743, or an amino acid sequence having at least 70%, 75%, 80%, 85%, 90%, 95%, or 99% identity to said linker and RT domain. In some embodiments, the gene modifying polypeptide further comprises an N-terminal methionine residue.

In some embodiments, the gene modifying polypeptide comprises, in N-terminal to C-terminal order, one or more (e.g., 1, 2, 3, 4, 5, or all 6) of an N-terminal methionine residue, a first nuclear localization signal (NLS) (e.g., of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto), a DNA binding domain (e.g., a Cas domain, e.g., a SpyCas9 domain, e.g., as listed in Table 8, or an amino acid sequence having at least 70%, 75%, 80%, 85%, 90%, 95%, or 99% identity thereto; or a DNA binding domain of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto), a linker (e.g., of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto), an RT domain (e.g., of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto), and a second NLS (e.g., of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto). In some embodiments, the gene modifying polypeptide further comprises (e.g., C-terminal to the second NLS) a T2A sequence and/or a puromycin sequence (e.g., of a gene modifying polypeptide of any one of SEQ ID NOs: 1-7743 and/or as listed in any of Tables A1, T1, T2, or D1-D12, or an amino acid sequence having at least 70%, 75%, 80%, 85%, 90%, 95%, or 99% identity thereto). In some embodiments, a nucleic acid encoding a gene modifying polypeptide (e.g., as described herein) encodes a T2A sequence, e.g., wherein the T2A sequence is situated between a region encoding the gene modifying polypeptide and a second region, wherein the second region optionally encodes a selectable marker, e.g., puromycin.

In certain embodiments, the first NLS comprises a first NLS sequence of a gene modifying polypeptide having an amino acid sequence of any one of SEQ ID NOs: 1-7743, or an amino acid sequence having at least 70%, 75%, 80%, 85%, 90%, 95%, or 99% identity thereto. In certain embodiments, the first NLS comprises a first NLS sequence of a gene modifying polypeptide as listed in any of Tables A1, T1, T2, or D1-D12, or an amino acid sequence having at least 70%, 75%, 80%, 85%, 90%, 95%, or 99% identity thereto. In certain embodiments, the first NLS sequence comprises a C-myc NLS. In certain embodiments, the first NLS comprises the amino acid sequence PAAKRVKLD (SEQ ID NO: 11,095), or an amino acid sequence having at least 70%, 75%, 80%, 85%, 90%, 95%, or 99% identity thereto.

In certain embodiments, the gene modifying polypeptide further comprises a spacer sequence between the first NLS and the DNA binding domain. In certain embodiments, the spacer sequence between the first NLS and the DNA binding domain comprises 1, 2, 3, 4, 5, 6, 7, 8, 9, or 10 amino acids. In certain embodiments, the spacer sequence between the first NLS and the DNA binding domain comprises the amino acid sequence GG.

In certain embodiments, the DNA binding domain comprises a DNA binding domain of a gene modifying polypeptide of any one of SEQ ID NOs: 1-7743, or an amino acid sequence having at least 70%, 75%, 80%, 85%, 90%, 95%, or 99% identity thereto. In certain embodiments, the DNA binding domain comprises a DNA binding domain of a gene modifying polypeptide as listed in any of Tables A1, T1, T2, or D1-D12, or an amino acid sequence having at least 70%, 75%, 80%, 85%, 90%, 95%, or 99% identity thereto. In certain embodiments, the DNA binding domain comprises a Cas domain (e.g., as listed in Table 8). In certain embodiments, the DNA binding domain comprises the amino acid sequence of a SpyCas9 polypeptide (e.g., as listed in Table 8, e.g., a Cas9 N863A polypeptide), or an amino acid sequence having at least 70%, 75%, 80%, 85%, 90%, 95%, or 99% identity thereto. In certain embodiments, the DNA binding domain comprises the amino acid sequence:

```
                                                       (SEQ ID NO: 11,096)
DKKYSIGLDIGTNSVGWAVITDEYKVPSKKFKVLGNTDRHSIKKNLIGALLFDSGETAEATRLKRTARRR

YTRRKNRICYLQEIFSNEMAKVDDSFFHRLEESFLVEEDKKHERHPIFGNIVDEVAYHEKYPTIYHLRKK

LVDSTDKADLRLIYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKDTYDDDLDNLLAQ

IGDQYADLFLAAKNLSDAILLSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRKORTFDNGSIPHQIHLGELHA

ILRRQEDFYPFLKDNREKIEKILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVMGRHKPENIVIEMARENQTTQ

KGQKNSRERMKRIEEGIKELGSQILKEHPVENTQLQNEKLYLYYLONGRDMYVDQELDINRLSDYDVDHI
```

-continued

```
VPQSFLKDDSIDNKVLTRSDKARGKSDNVPSEEVVKKMKNYWRQLLNAKLITORKFDNLTKAERGGLSEL

DKAGFIKRQLVETRQITKHVAQILDSRMNTKYDENDKLIREVKVITLKSKLVSDFRKDFQFYKVREINNY

HHAHDAYLNAVVGTALIKKYPKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQTGGFSKESILPKRNSDKLIA

RKKDWDPKKYGGFDSPTVAYSVLVVAKVEKGKSKKLKSVKELLGITIMERSSFEKNPIDFLEAKGYKEVK

KDLIIKLPKYSLFELENGRKRMLASAGELQKGNELALPSKYVNFLYLASHYEKLKGSPEDNEQKOLFVEQ

HKHYLDEIIEQISEFSKRVILADANLDKVLSAYNKHRDKPIREQAENIIHLFTLTNLGAPAAFKYFDTTI

DRKRYTSTKEVLDATLIHQSITGLYETRIDLSQLGGD,
``` or an amino acid sequence having at least 70%, 75%, 80%, 85%, 90%, 95%, or 99% identity thereto.

In certain embodiments, the gene modifying polypeptide further comprises a spacer sequence between the DNA binding domain and the linker. In certain embodiments, the spacer sequence between the DNA binding domain and the linker comprises 1, 2, 3, 4, 5, 6, 7, 8, 9, or 10 amino acids. In certain embodiments, the spacer sequence between the DNA binding domain and the linker comprises the amino acid sequence GG.

In certain embodiments, the linker comprises a linker sequence of a gene modifying polypeptide of any one of SEQ ID NOs: 1-7743, or an amino acid sequence having at least 70%, 75%, 80%, 85%, 90%, 95%, or 99% identity thereto. In certain embodiments, the linker comprises a linker sequence of a gene modifying polypeptide as listed in any of Tables A1, T1, T2, or D1-D12, or an amino acid sequence having at least 70%, 75%, 80%, 85%, 90%, 95%, or 99% identity thereto. In certain embodiments, the linker comprises an amino acid sequence as listed in Table 1 or 10, or an amino acid sequence having at least 70%, 75%, 80%, 85%, 90%, 95%, or 99% identity thereto.

In certain embodiments, the gene modifying polypeptide further comprises a spacer sequence between the linker and the RT domain. In certain embodiments, the spacer sequence between the linker and the RT domain comprises 1, 2, 3, 4, 5, 6, 7, 8, 9, or 10 amino acids. In certain embodiments, the spacer sequence between the linker and the RT domain comprises the amino acid sequence GG.

In certain embodiments, the RT domain comprises a RT domain sequence of a gene modifying polypeptide of any one of SEQ ID NOs: 1-7743, or an amino acid sequence having at least 70%, 75%, 80%, 85%, 90%, 95%, or 99% identity thereto. In certain embodiments, the RT domain comprises a RT domain sequence of a gene modifying polypeptide as listed in any of Tables A1, T1, T2, or D1-D12, or an amino acid sequence having at least 70%, 75%, 80%, 85%, 90%, 95%, or 99% identity thereto. In certain embodiments, the RT domain comprises an amino acid sequence as listed in Table 1 or 6, or an amino acid sequence having at least 70%, 75%, 80%, 85%, 90%, 95%, or 99% identity thereto. In some embodiments, the RT domain has a length of about 400-500, 500-600, 600-700, 700-800, 800-900, or 900-1000 amino acids.

In certain embodiments, the gene modifying polypeptide further comprises a spacer sequence between the RT domain and the second NLS. In certain embodiments, the spacer sequence between the RT domain and the second NLS comprises 1, 2, 3, 4, 5, 6, 7, 8, 9, or 10 amino acids. In certain embodiments, the spacer sequence between the RT domain and the second NLS comprises the amino acid sequence AG.

In certain embodiments, the second NLS comprises a second NLS sequence of a gene modifying polypeptide of any one of SEQ ID NOs: 1-7743. In certain embodiments, the second NLS comprises a second NLS sequence of a gene modifying polypeptide as listed in any of Tables A1, T1, T2, or D1-D12. In certain embodiments, the second NLS sequence comprises a plurality of partial NLS sequences. In embodiments, the NLS sequence, e.g., the second NLS sequence, comprises a first partial NLS sequence, e.g., comprising the amino acid sequence KRTADGSEFE (SEQ ID NO: 11,097), or an amino acid sequence having at least 70%, 75%, 80%, 85%, 90%, 95%, or 99% identity thereto. In embodiments, the NLS sequence, e.g., the second NLS sequence, comprises a second partial NLS sequence. In embodiments, the NLS sequence, e.g., the second NLS sequence, comprises an SV40A5 NLS, e.g., a bipartite SV40A5 NLS, e.g., comprising the amino acid sequence KRTADGSEFESPKKKAKVE (SEQ ID NO: 11,098), or an amino acid sequence having at least 70%, 75%, 80%, 85%, 90%, 95%, or 99% identity thereto. In certain embodiments, the NLS sequence, e.g., the second NLS sequence, comprises the amino acid sequence KRTADGSEFEKR-TADGSEFESPKKKAKVE (SEQ ID NO: 11,099), or an amino acid sequence having at least 70%, 75%, 80%, 85%, 90%, 95%, or 99% identity thereto.

In certain embodiments, the gene modifying polypeptide further comprises a spacer sequence between the second NLS and the T2A sequence and/or puromycin sequence. In certain embodiments, the spacer sequence between the second NLS and the T2A sequence and/or puromycin sequence comprises 1, 2, 3, 4, 5, 6, 7, 8, 9, or 10 amino acids. In certain embodiments, the spacer sequence between the second NLS and the T2A sequence and/or puromycin sequence comprises the amino acid sequence GSG.

Linkers and RT Domains

In some embodiments, the gene modifying polypeptide comprises a linker (e.g., as described herein) and an RT domain (e.g., as described herein). In certain embodiments, the gene modifying polypeptide comprises, in N-terminal to C-terminal order, a linker (e.g., as described herein) and an RT domain (e.g., as described herein).

In certain embodiments, the linker comprises a linker sequence as listed in Table 10, or an amino acid sequence having at least 70%, 75%, 80%, 85%, 90%, 95%, or 99% identity thereto. In certain embodiments, the linker comprises a linker sequence of any one of SEQ ID NOs: 1-7743, or an amino acid sequence having at least 70%, 75%, 80%, 85%, 90%, 95%, or 99% identity thereto. In certain embodiments, the linker comprises a linker sequence of any one of SEQ ID NOs: 6001-7743, or an amino acid sequence having at least 70%, 75%, 80%, 85%, 90%, 95%, or 99% identity thereto. In certain embodiments, the linker comprises a linker sequence of any one of SEQ ID NOs: 4501-4541, or an amino acid sequence having at least 70%, 75%, 80%, 85%, 90%, 95%, or 99% identity thereto. In certain embodiments, the linker comprises a linker sequence of an exemplary gene modifying polypeptide listed in Table A1, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table T1, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table T2, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D1, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D2, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D3, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D4, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D5, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D6, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D7, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D8, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D9, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D10, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D11, or an amino acid sequence having at least 70%, 75%, 80%, 85%, 90%, 95%, or 99% identity thereto. In certain embodiments, the linker comprises a linker sequence of a gene modifying polypeptide having the amino acid sequence of a SEQ ID NO: listed in Table D12, or an amino acid sequence having at least 70%, 75%, 80%, 85%, 90%, 95%, or 99% identity thereto.

In certain embodiments, the RT domain comprises an RT domain sequence as listed in Table 6, or an amino acid sequence having at least 70%, 75%, 80%, 85%, 90%, 95%, or 99% identity thereto. In certain embodiments, the RT domain comprises an RT domain sequence of an exemplary gene modifying polypeptide listed in Table A1, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table T1, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table T2, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D1, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D2, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D3, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D4, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D5, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D6, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D7, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D8, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D9, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D10, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D11, or an amino acid sequence having at least 70%, 75%, 80%, 85%, 90%, 95%, or 99% identity thereto. In certain embodiments, the RT domain comprises a RT domain sequence of a gene modifying polypeptide having the amino acid sequence of a SEQ ID NO: listed in Table D12, or an amino acid sequence having at least 70%, 75%, 80%, 85%, 90%, 95%, or 99% identity thereto.

In some embodiments, a gene modifying polypeptide comprises a portion of a gene modifying polypeptide of any one of SEQ ID NOs: 1-7743, wherein the portion comprises a linker and RT domain, or an amino acid sequence having at least 70%, 75%, 80%, 85%, 90%, 95%, or 99% identity to said portion.

In some embodiments, a gene modifying polypeptide comprises a linker of a gene modifying polypeptide of any one of SEQ ID NOs: 1-7743, or an amino acid sequence having at least 70%, 75%, 80%, 85%, 90%, 95%, or 99% identity to said linker. In some embodiments, a gene modifying polypeptide comprises a linker of a gene modifying polypeptide of any one of SEQ ID NOs: 6001-7743, or an amino acid sequence having at least 70%, 75%, 80%, 85%, 90%, 95%, or 99% identity to said linker. In some embodiments, a gene modifying polypeptide comprises a linker of a gene modifying polypeptide of any one of SEQ ID NOs: 4501-4541, or an amino acid sequence having at least 70%, 75%, 80%, 85%, 90%, 95%, or 99% identity to said linker. In some embodiments, a gene modifying polypeptide comprises a linker of a gene modifying polypeptide as listed in any of Tables A1, T1, T2, or D1-D12, or a linker comprising an amino acid sequence having at least 70%, 75%, 80%, 85%, 90%, 95%, or 99% identity thereto.

In some embodiments, a gene modifying polypeptide comprises an RT domain of a gene modifying polypeptide of any one of SEQ ID NOs: 1-7743, or an amino acid sequence having at least 70%, 75%, 80%, 85%, 90%, 95%, or 99% identity to said RT domain. In some embodiments, a gene modifying polypeptide comprises an RT domain of a gene modifying polypeptide of any one of SEQ ID NOs: 6001-7743, or an amino acid sequence having at least 70%, 75%, 80%, 85%, 90%, 95%, or 99% identity said RT domain. In some embodiments, a gene modifying polypeptide comprises an RT domain of a gene modifying polypeptide of any one of SEQ ID NOs: 4501-4541, or an amino acid sequence having at least 70%, 75%, 80%, 85%, 90%, 95%, or 99% identity said RT domain. In some embodiments, a gene modifying polypeptide comprises an RT domain of a gene modifying polypeptide as listed in any of Tables A1, T1, T2, or D1-D12, or an RT domain comprising an amino acid sequence having at least 70%, 75%, 80%, 85%, 90%, 95%, or 99% identity thereto.

In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 1-7743. In certain embodiments, the linker and the RT domain of a gene modifying polypeptide comprise amino acid sequences of a linker and RT domain having at least 80% identity to the linker and RT domains of any one of SEQ ID NOs: 1-7743. In certain embodiments, the linker and the RT domain of a gene modifying polypeptide comprise amino acid sequences of a linker and RT domain having at least 90% identity to the linker and RT domains of any one of SEQ ID NOs: 1-7743. In certain embodiments, the linker and the RT domain of a gene modifying polypeptide comprise amino acid sequences of a linker and RT domain having at least 95% identity to the linker and RT domains of any one of SEQ ID NOs: 1-7743. In certain embodiments, the linker and the RT domain of a gene modifying polypeptide comprise amino acid sequences of a linker and RT domain having at least 99% identity to the linker and RT domains of any one of SEQ ID NOs: 1-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 6001-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) of a gene modifying polypeptide having the amino acid sequence of any one of SEQ ID NOs: 4501-4541. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from a single row of any of Tables A1, T1, T2, or D1-D12 (e.g., from a single exemplary gene modifying polypeptide as listed in any of Tables A1, T1, T2, or D1-D12).

In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from two different amino acid sequences selected from SEQ ID NOs: 1-7743. In certain embodiments, the linker and the RT domain of a gene modifying polypeptide comprise the amino acid sequences of a linker and RT domain (or amino acid sequences having at least 70%, 75%, 80%, 85%, 90%, 95%, or 99% identity thereto) from different rows of any of Tables A1, T1, T2, or D1-D12.

In certain embodiments, the gene modifying polypeptide further comprises a first NLS (e.g., a 5' NLS), e.g., as described herein. In certain embodiments, the gene modifying polypeptide further comprises a second NLS (e.g., a 3' NLS), e.g., as described herein. In certain embodiments, the gene modifying polypeptide further comprises an N-terminal methionine residue.

RT Families and Mutants

In certain embodiments, a gene modifying polypeptide comprises comprises the amino acid sequence of an RT domain sequence from a family selected from: AVIRE, BAEVM, FFV, FLV, FOAMV, GALV, KORV, MLVAV, MLVBM, MLVCB, MLVFF, MLVMS, PERV, SFV1, SFV3L, WMSV, XMRV6, BLVAU, BLVJ, HTL1A, HTL1C, HTL1L, HTL32, HTL3P, HTLV2, JSRV, MLVF5, MLVRD, MMTVB, MPMV, SFVCP, SMRVH, SRV1, SRV2, and WDSV. In certain embodiments, a gene modifying polypeptide comprises comprises the amino acid sequence of an RT domain sequence from a family selected from: AVIRE, BAEVM, FFV, FLV, FOAMV, GALV, KORV, MLVAV, MLVBM, MLVCB, MLVFF, MLVMS, PERV, SFV1, SFV3L, WMSV, and XMRV6.

In certain embodiments, a gene modifying polypeptide comprises comprises the amino acid sequence of an RT domain sequence from an MLVMS RT domain. In embodiments, the amino acid sequence of an RT domain sequence comprises one or more point mutations as listed in column 1 of Table M1, or a point mutation corresponding thereto. In embodiments, the amino acid sequence of an RT domain sequence comprises one or more point mutations as listed in column 3 of Table M1 (MLVMS), or a point mutation corresponding thereto. In embodiments, the amino acid sequence of an RT domain sequence comprises one or more point mutations at an amino acid position of the RT domain as listed in columns 1 and 2 of Table M2, or an amino acid position corresponding thereto.

In certain embodiments, a gene modifying polypeptide comprises comprises the amino acid sequence of an RT domain sequence from an AVIRE RT domain. In embodiments, the amino acid sequence of an RT domain sequence comprises one or more point mutations as listed in column 2 of Table M1, or a point mutation corresponding thereto. In embodiments, the amino acid sequence of an RT domain sequence comprises one or more point mutations as listed in column 4 of Table M1 (AVIRE), or a point mutation corresponding thereto. In embodiments, the amino acid sequence of an RT domain sequence comprises one or more point mutations at an amino acid position of the RT domain as listed in columns 3 and 4 of Table M2, or an amino acid position corresponding thereto. In certain embodiments, the RT domain comprises an IENSSP (SEQ ID NO: 15465) (e.g., at the C-terminus).

TABLE M1

Exemplary point mutations in MLVMS and AVIRE RT domains

| RT-linker filing (MLVMS) | Corresponding AVIRE | MLVMS (PLV4921) | AVIRE (PLV10990) |
|---|---|---|---|
| | H8Y | | |
| P51L | Q51L | | |
| S67R | T67R | | |
| E67K | E67K | | |
| E69K | E69K | | |
| T197A | T197A | | |
| D200N | D200N | D200N | D200N |
| H204R | N204R | | |
| E302K | E302K | | |
| | | T306K | T306K |
| F309N | Y309N | | |
| W313F | W313F | W313F | W313F |
| T330P | G330P | T330P | G330P |
| L435G | T436G | | |
| N454K | N455K | | |
| D524G | D526G | | |
| E562Q | E564Q | | |
| D583N | D585N | | |
| H594Q | H596Q | | |
| L603W | L605W | L603W | L605W |
| D653N | D655N | | |
| L671P | L673P | | |

IENSSP (SEQ ID NO: 15465) at C-term

TABLE M2

Positions that can be mutated in exemplary MLVMS and AVIRE RT domains
WT residue & position

| MLVMS aa | MLVMS position #* | AVIRE aa | AVIRE position #* |
|---|---|---|---|
| H | 8 | Y | 8 |
| P | 51 | Q | 51 |
| S | 67 | T | 67 |
| E | 69 | E | 69 |
| T | 197 | T | 197 |
| D | 200 | D | 200 |
| H | 204 | N | 204 |
| E | 302 | E | 302 |
| T | 306 | T | 306 |
| F | 309 | Y | 309 |
| W | 313 | W | 313 |
| T | 330 | G | 330 |
| L | 435 | T | 436 |
| N | 454 | N | 455 |
| D | 524 | D | 526 |
| E | 562 | E | 564 |
| D | 583 | D | 585 |
| H | 594 | H | 596 |
| L | 603 | L | 605 |
| D | 653 | D | 655 |
| L | 671 | S | 673 |

In certain embodiments, a gene modifying polypeptide comprises a gamma retrovirus derived RT domain. In certain embodiments, the gamma retrovirus-derived RT domain of a gene modifying polypeptide comprises the amino acid sequence of an RT domain sequence from a family selected from: AVIRE, BAEVM, FFV, FLV, FOAMV, GALV, KORV, MLVAV, MLVBM, MLVCB, MLVFF, MLVMS, PERV, SFV1, SFV3L, WMSV, and XMRV6. In some embodiments, the gamma retrovirus-derived RT domain of a gene modifying polypeptide is not derived from PERV. In some embodiments, said RT includes one, two, three, four, five, six or more mutations shown in Table 2 and corresponding to mutations D200N, L603W, T330P, D524G, E562Q, D583N, P51L, S67R, E67K, T197A, H204R, E302K, F309N, W313F, L435G, N454K, H594Q, L671P, E69K, or D653N in the RT domain of murine leukemia virus reverse transcriptase. In some embodiments, the gene modifying polypeptide further comprises a linker having at least 99% identity to a linker domains of any one of SEQ ID NOs: 1-7743. In some embodiments, the gene modifying polypeptide further comprises a linker having at least 99% or 100% identity to SEQ ID NO: 5217 or SEQ ID NO:11,041.

In embodiments, the RT domain comprises the amino acid sequence of an RT domain of an AVIRE RT (e.g., an AVIRE_P03360 sequence, e.g., SEQ ID NO: 8001), or an amino acid sequence having at least 70%, 75%, 80%, 85%, 90%, 95%, or 99% identity thereto. In some embodiments, the RT domain comprises the amino acid sequence of an AVIRE RT further comprising one, two, three, four, or five mutations selected from the group consisting of D200N, G330P, L605W, T306K, and W313F, or a corresponding position in a homologous RT domain. In some embodiments, the RT domain comprises the amino acid sequence of an AVIRE RT further comprising one, two, or three mutations selected from the group consisting of D200N, G330P, and L605W, or a corresponding position in a homologous RT domain.

In embodiments, the RT domain comprises the amino acid sequence of an RT domain of a BAEVM RT (e.g., an BAEVM_P10272 sequence, e.g., SEQ ID NO: 8004), or an amino acid sequence having at least 70%, 75%, 80%, 85%, 90%, 95%, or 99% identity thereto. In some embodiments, the RT domain comprises the amino acid sequence of a BAEVM RT further comprising one, two, three, four, or five mutations selected from the group consisting of D198N, E328P, L602W, T304K, and W311F, or a corresponding position in a homologous RT domain. In some embodiments, the RT domain comprises the amino acid sequence of a BAEVM RT further comprising one, two, or three mutations selected from the group consisting of D198N, E328P, and L602W, or a corresponding position in a homologous RT domain.

In embodiments, the RT domain comprises the amino acid sequence of an RT domain of an FFV RT (e.g., an FFV_O93209 sequence, e.g., SEQ ID NO: 8012), or an amino acid sequence having at least 70%, 75%, 80%, 85%, 90%, 95%, or 99% identity thereto. In some embodiments, the RT domain comprises the amino acid sequence of an FFV RT further comprising one, two, three, or four mutations selected from the group consisting of D21N, T293N, T419P, and L393K, or a corresponding position in a homologous RT domain. In some embodiments, the RT domain comprises the amino acid sequence of an FFV RT further comprising one, two, or three mutations selected from the group consisting of D21N, T293N, and T419P, or a corresponding position in a homologous RT domain. In some embodiments, the RT domain comprises the amino acid sequence of an FFV RT further comprising the mutation D21N. In some embodiments, the RT domain comprises the amino acid sequence of an FFV RT further comprising one, two, or three mutations selected from the group consisting of T207N, T333P, and L307K, or a corresponding position in a homologous RT domain. In some embodiments, the RT domain comprises the amino acid sequence of an FFV RT further comprising one or two mutations selected from the group consisting of T207N and T333P, or a corresponding position in a homologous RT domain.

In embodiments, the RT domain comprises the amino acid sequence of an RT domain of an FLV RT (e.g., an FLV_P10273 sequence, e.g., SEQ ID NO: 8019), or an amino acid sequence having at least 70%, 75%, 80%, 85%, 90%, 95%, or 99% identity thereto. In some embodiments, the RT domain comprises the amino acid sequence of an FLV RT further comprising one, two, three, or four mutations selected from the group consisting of D199N, L602W, T305K, and W312F, or a corresponding position in a homologous RT domain. In some embodiments, the RT domain comprises the amino acid sequence of an FLV RT further comprising one or two mutations selected from the group consisting of D199N and L602W, or a corresponding position in a homologous RT domain.

In embodiments, the RT domain comprises the amino acid sequence of an RT domain of a FOAMV RT (e.g., an FOAMV_P14350 sequence, e.g., SEQ ID NO: 8021), or an amino acid sequence having at least 70%, 75%, 80%, 85%, 90%, 95%, or 99% identity thereto. In some embodiments, the RT domain comprises the amino acid sequence of an FOAMV RT further comprising one, two, three, or four mutations selected from the group consisting of D24N, T296N, S420P, and L396K, or a corresponding position in a homologous RT domain. In some embodiments, the RT domain comprises the amino acid sequence of an FOAMV RT further comprising one, two, or three mutations selected from the group consisting of D24N, T296N, and S420P, or a corresponding position in a homologous RT domain. In some embodiments, the RT domain comprises the amino acid sequence of an FOAMV RT further comprising the mutation D24N, or a corresponding position in a homologous RT domain. In some embodiments, the RT domain comprises the amino acid sequence of an FOAMV RT further comprising one, two, or three mutations selected from the group consisting of T207N, S331P, and L307K, or a corresponding position in a homologous RT domain. In some embodiments, the RT domain comprises the amino acid sequence of an FOAMV RT further comprising one or two mutations selected from the group consisting of T207N and S331P, or a corresponding position in a homologous RT domain.

In embodiments, the RT domain comprises the amino acid sequence of an RT domain of a GALV RT (e.g., an GALV_P21414 sequence, e.g., SEQ ID NO: 8027), or an amino acid sequence having at least 70%, 75%, 80%, 85%, 90%, 95%, or 99% identity thereto. In some embodiments, the RT domain comprises the amino acid sequence of a GALV RT further comprising one, two, three, four, or five mutations selected from the group consisting of D198N, E328P, L600W, T304K, and W311F, or a corresponding position in a homologous RT domain. In some embodiments, the RT domain comprises the amino acid sequence of a GALV RT further comprising one, two, or three mutations selected from the group consisting of D198N, E328P, and L600W, or a corresponding position in a homologous RT domain.

In embodiments, the RT domain comprises the amino acid sequence of an RT domain of a KORV RT (e.g., an KORV_Q9TTC1 sequence, e.g., SEQ ID NO: 8047), or an amino acid sequence having at least 70%, 75%, 80%, 85%, 90%, 95%, or 99% identity thereto. In some embodiments, the RT domain comprises the amino acid sequence of a GALV RT further comprising one, two, three, four, five, or six mutations selected from the group consisting of D32N, D322N, E452P, L274W, T428K, and W435F, or a corresponding position in a homologous RT domain. In some embodiments, the RT domain comprises the amino acid sequence of a GALV RT further comprising one, two, three, or four mutations selected from the group consisting of D32N, D322N, E452P, and L274W, or a corresponding position in a homologous RT domain. In some embodiments, the RT domain comprises the amino acid sequence of a GALV RT further comprising the mutation D32N. In some embodiments, the RT domain comprises the amino acid sequence of a KORV RT further comprising one, two, three, four, or five mutations selected from the group consisting of D231N, E361P, L633W, T337K, and W344F, or a corresponding position in a homologous RT domain. In some embodiments, the RT domain comprises the amino acid sequence of a KORV RT further comprising one, two, or three mutations selected from the group consisting of D231N, E361P, and L633W, or a corresponding position in a homologous RT domain.

In embodiments, the RT domain comprises the amino acid sequence of an RT domain of a MLVAV RT (e.g., an MLVAV_P03356 sequence, e.g., SEQ ID NO: 8053), or an amino acid sequence having at least 70%, 75%, 80%, 85%, 90%, 95%, or 99% identity thereto. In some embodiments, the RT domain comprises the amino acid sequence of a MLVAV RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVAV RT further comprising one, two, or three mutations selected from the group consisting of D200N, T330P, and L603W, or a corresponding position in a homologous RT domain.

In embodiments, the RT domain comprises the amino acid sequence of an RT domain of a MLVBM RT (e.g., an MLVBM_Q7SVK7 sequence, e.g., SEQ ID NO: 8056), or an amino acid sequence having at least 70%, 75%, 80%, 85%, 90%, 95%, or 99% identity thereto. In some embodiments, the RT domain comprises the amino acid sequence of a MLVBM RT further comprising one, two, three, four, or five mutations selected from the group consisting of D199N, T329P, L602W, T305K, and W312F, or a corresponding position in a homologous RT domain. In some embodiments, the RT domain comprises the amino acid sequence of a MLVBM RT further comprising one, two, and three mutations selected from the group consisting of D200N, T330P, and L603W, or a corresponding position in a homologous RT domain.

In embodiments, the RT domain comprises the amino acid sequence of an RT domain of a MLVCB RT (e.g., an MLVCB_P08361 sequence, e.g., SEQ ID NO: 8062), or an amino acid sequence having at least 70%, 75%, 80%, 85%, 90%, 95%, or 99% identity thereto. In some embodiments, the RT domain comprises the amino acid sequence of a MLVCB RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVCB RT further comprising one, two, and three mutations selected from the group consisting of D200N, T330P, and L603W, or a corresponding position in a homologous RT domain.

In embodiments, the RT domain comprises the amino acid sequence of an RT domain of a MLVFF RT, or an amino acid sequence having at least 70%, 75%, 80%, 85%, 90%, 95%, or 99% identity thereto. In some embodiments, the RT domain comprises the amino acid sequence of a MLVFF RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVFF RT further comprising one, two, and three mutations selected from the group consisting of D200N, T330P, and L603W, or a corresponding position in a homologous RT domain.

In embodiments, the RT domain comprises the amino acid sequence of an RT domain of a MLVMS RT (e.g., an MLVMS_reference sequence, e.g., SEQ ID NO: 8137; or an MLVMS_P03355 sequence, e.g., SEQ ID NO: 8070), or an amino acid sequence having at least 70%, 75%, 80%, 85%, 90%, 95%, or 99% identity thereto. In some embodiments, the RT domain comprises the amino acid sequence of a MLVMS RT further comprising one, two, three, four, five, or six mutations selected from the group consisting of D200N, T330P, L603W, T306K, W313F, and H8Y, or a corresponding position in a homologous RT domain. In some embodiments, the RT domain comprises the amino acid sequence of a MLVMS RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a MLVMS RT further comprising one, two, or three mutations selected from the group consisting of D200N, T330P, and L603W, or a corresponding position in a homologous RT domain.

In embodiments, the RT domain comprises the amino acid sequence of an RT domain of a PERV RT (e.g., an PERV_Q4VFZ2sequence, e.g., SEQ ID NO: 8099), or an amino acid sequence having at least 70%, 75%, 80%, 85%, 90%, 95%, or 99% identity thereto. In some embodiments, the RT domain comprises the amino acid sequence of a PERV RT further comprising one, two, three, four, or five mutations selected from the group consisting of D196N, E326P, L599W, T302K, and W309F, or a corresponding position in a homologous RT domain. In some embodiments, the RT domain comprises the amino acid sequence of a PERV RT further comprising one, two, or three mutations selected from the group consisting of D196N, E326P, and L599W, or a corresponding position in a homologous RT domain.

In embodiments, the RT domain comprises the amino acid sequence of an RT domain of a SFV1 RT (e.g., an SFV1_P23074 sequence, e.g., SEQ ID NO: 8105), or an amino acid sequence having at least 70%, 75%, 80%, 85%, 90%, 95%, or 99% identity thereto. In some embodiments, the RT domain comprises the amino acid sequence of a SFV1 RT further comprising one, two, three, or four mutations selected from the group consisting of D24N, T296N, N420P, and L396K, or a corresponding position in a homologous RT domain. In some embodiments, the RT domain comprises the amino acid sequence of a SFV1 RT further comprising one, two, or three mutations selected from the group consisting of D24N, T296N, and N420P, or a corresponding position in a homologous RT domain. In some embodiments, the RT domain comprises the amino acid sequence of a SFV1 RT further comprising the D24N, or a corresponding position in a homologous RT domain.

In embodiments, the RT domain comprises the amino acid sequence of an RT domain of a SFV3L RT (e.g., an SFV3L_P27401 sequence, e.g., SEQ ID NO: 8111), or an amino acid sequence having at least 70%, 75%, 80%, 85%, 90%, 95%, or 99% identity thereto. In some embodiments, the RT domain comprises the amino acid sequence of a SFV3L RT further comprising one, two, three, or four mutations selected from the group consisting of D24N, T296N, N422P, and L396K, or a corresponding position in a homologous RT domain. In some embodiments, the RT domain comprises the amino acid sequence of a SFV3L RT further comprising one, two, or three mutations selected from the group consisting of D24N, T296N, and N422P, or a corresponding position in a homologous RT domain. In some embodiments, the RT domain comprises the amino acid sequence of a SFV3L RT further comprising the mutation D24N, or a corresponding position in a homologous RT domain. In some embodiments, the RT domain comprises the amino acid sequence of a SFV3L RT further comprising one, two, or three mutations selected from the group consisting of T307N, N333P, and L307K, or a corresponding position in a homologous RT domain. In some embodiments, the RT domain comprises the amino acid sequence of a SFV3L RT further comprising one or two mutations selected from the group consisting of T307N and N333P, or a corresponding position in a homologous RT domain.

In embodiments, the RT domain comprises the amino acid sequence of an RT domain of a WMSV RT (e.g., an WMSV_P03359 sequence, e.g., SEQ ID NO: 8131), or an amino acid sequence having at least 70%, 75%, 80%, 85%, 90%, 95%, or 99% identity thereto. In some embodiments, the RT domain comprises the amino acid sequence of a WMSV RT further comprising one, two, three, four, or five mutations selected from the group consisting of D198N, E328P, L600W, T304K, and W311F, or a corresponding position in a homologous RT domain. In some embodiments, the RT domain comprises the amino acid sequence of a WMSV RT further comprising one, two, or three mutations selected from the group consisting of D198N, E328P, and L600W, or a corresponding position in a homologous RT domain.

In embodiments, the RT domain comprises the amino acid sequence of an RT domain of a XMRV6 RT (e.g., an XMRV6 A1Z651 sequence, e.g., SEQ ID NO: 8134), or an amino acid sequence having at least 70%, 75%, 80%, 85%, 90%, 95%, or 99% identity thereto. In some embodiments, the RT domain comprises the amino acid sequence of a XMRV6 RT further comprising one, two, three, four, or five mutations selected from the group consisting of D200N, T330P, L603W, T306K, and W313F, or a corresponding position in a homologous RT domain. In some embodiments, the RT domain comprises the amino acid sequence of a XMRV6 RT further comprising one, two, or three mutations selected from the group consisting of D200N, T330P, and L603W, or a corresponding position in a homologous RT domain.

In certain embodiments, the RT domain of a gene modifying polypeptide comprises the amino acid sequence of an RT domain of an AVIRE RT, or an amino acid sequence having at least 70%, 75%, 80%, 85%, 90%, 95%, or 99% identity thereto. In embodiments, the RT domain comprises the amino acid sequence of an RT domain comprised in a sequence listed in column 1 of Table A5, or an amino acid sequence having at least 70%, 75%, 80%, 85%, 90%, 95%, or 99% identity thereto. In some embodiments, the gene modifying polypeptide further comprises a linker having at least 99% or 100% identity to SEQ ID NO: 5217 or SEQ ID NO:11,041.

In certain embodiments, the RT domain of a gene modifying polypeptide comprises the amino acid sequence of an RT domain of an MLVMS RT, or an amino acid sequence having at least 70%, 75%, 80%, 85%, 90%, 95%, or 99% identity thereto. In embodiments, the RT domain comprises the amino acid sequence of an RT domain comprised in a sequence listed in any of columns 2-6 of Table A5, or an amino acid sequence having at least 70%, 75%, 80%, 85%, 90%, 95%, or 99% identity thereto. In some embodiments, the gene modifying polypeptide further comprises a linker having at least 99% or 100% identity to SEQ ID NO: 5217 or SEQ ID NO:11,041.

TABLE A5

Exemplary gene modifying polypeptides comprising an AVIRE RT domain or an MLVMS RT domain.

| AVIRE SEQ ID NOs: | MLVMS SEQ ID NOs: | | | | |
|---|---|---|---|---|---|
| 1 | 2704 | 3007 | 3038 | 2638 | 2930 |
| 2 | 2706 | 3007 | 3038 | 2639 | 2930 |
| 3 | 2708 | 3008 | 3039 | 2639 | 2931 |
| 4 | 2709 | 3008 | 3039 | 2640 | 2931 |
| 5 | 2709 | 3009 | 3040 | 2640 | 2932 |
| 6 | 2710 | 3010 | 3040 | 2641 | 2932 |
| 7 | 2957 | 3010 | 3041 | 2641 | 2933 |
| 9 | 2957 | 3011 | 3041 | 2642 | 2933 |
| 10 | 2958 | 3012 | 3042 | 2642 | 2934 |
| 12 | 2959 | 3012 | 3042 | 2643 | 2934 |
| 13 | 2960 | 3013 | 3043 | 2643 | 2935 |
| 14 | 2962 | 3013 | 3043 | 2644 | 2935 |
| 6076 | 6042 | 3014 | 3044 | 2644 | 2936 |
| 6143 | 6068 | 3014 | 3044 | 2645 | 2936 |
| 6200 | 6097 | 3015 | 3045 | 2645 | 2937 |
| 6254 | 6136 | 3015 | 3045 | 2646 | 2937 |
| 6274 | 6156 | 3016 | 3046 | 2646 | 2938 |
| 6315 | 6215 | 3016 | 3046 | 2647 | 2938 |
| 6328 | 6216 | 3017 | 3047 | 2647 | 2939 |
| 6337 | 6301 | 3018 | 3047 | 2648 | 2939 |
| 6403 | 6352 | 3018 | 3048 | 2648 | 2940 |

TABLE A5-continued

Exemplary gene modifying polypeptides comprising an AVIRE RT domain or an MLVMS RT domain.

| AVIRE SEQ ID NOs: | MLVMS SEQ ID NOs: | | | | |
|---|---|---|---|---|---|
| 6420 | 6365 | 3019 | 3048 | 2649 | 2940 |
| 6440 | 6411 | 3019 | 3049 | 2649 | 2941 |
| 6513 | 6436 | 3020 | 3049 | 2650 | 2941 |
| 6552 | 6458 | 3020 | 3050 | 2650 | 2942 |
| 6613 | 6459 | 3021 | 3051 | 2651 | 2942 |
| 6671 | 6524 | 3021 | 3051 | 2651 | 2943 |
| 6822 | 6562 | 3022 | 3052 | 2652 | 2943 |
| 6840 | 6563 | 3023 | 3052 | 2652 | 2944 |
| 6884 | 6699 | 3023 | 3053 | 2653 | 2945 |
| 6907 | 6865 | 3024 | 3053 | 2653 | 2945 |
| 6970 | 7022 | 3024 | 3054 | 2654 | 2946 |
| 7025 | 7037 | 3025 | 3054 | 2655 | 2946 |
| 7052 | 7088 | 3025 | 3055 | 2655 | 2947 |
| 7078 | 7116 | 3026 | 3055 | 2656 | 2947 |
| 7243 | 7175 | 3026 | 3056 | 2656 | 2948 |
| 7253 | 7200 | 3027 | 3056 | 2657 | 2948 |
| 7318 | 7206 | 3027 | 3057 | 2657 | 2949 |
| 7379 | 7277 | 3028 | 3057 | 2658 | 2949 |
| 7486 | 7294 | 3028 | 3058 | 2658 | 2950 |
| 7524 | 7330 | 3029 | 3058 | 2659 | 2950 |
| 7668 | 7411 | 3030 | 3059 | 2659 | 2951 |
| 7680 | 7455 | 3030 | 3059 | 2660 | 2951 |
| 7720 | 7477 | 3031 | 3060 | 2660 | 2952 |
| 1137 | 7511 | 3031 | 3060 | 2661 | 2952 |
| 1138 | 7538 | 3032 | 3061 | 2661 | 2953 |
| 1139 | 7559 | 3032 | 3061 | 2662 | 2953 |
| 1140 | 7560 | 3033 | 3062 | 2662 | 2954 |
| 1141 | 7593 | 3033 | 3062 | 2663 | 2954 |
| 1142 | 7594 | 3034 | 3063 | 2663 | 2955 |
| 1143 | 7607 | 3034 | 3063 | 2664 | 2955 |
| 1144 | 7623 | 6025 | 3064 | 2664 | 6485 |
| 1145 | 7638 | 6041 | 3064 | 2665 | 6486 |
| 1146 | 7717 | 6043 | 3065 | 2665 | 6504 |
| 1147 | 7731 | 6098 | 3065 | 2666 | 6505 |
| 1148 | 7732 | 6099 | 3066 | 2666 | 6595 |
| 1149 | 2711 | 6180 | 3066 | 2667 | 6596 |
| 1150 | 2711 | 6182 | 3067 | 2667 | 6751 |
| 1151 | 2712 | 6237 | 3067 | 2668 | 6752 |
| 1152 | 2712 | 6238 | 3068 | 2668 | 6777 |
| 1153 | 2713 | 6311 | 3068 | 2669 | 6778 |
| 1154 | 2713 | 6312 | 3069 | 2669 | 7172 |
| 1155 | 2714 | 6578 | 3069 | 2670 | 7174 |
| 1156 | 2714 | 6579 | 3070 | 2670 | 7313 |
| 1157 | 2715 | 6663 | 3070 | 2671 | 7314 |
| 1158 | 2715 | 6664 | 3071 | 2671 | |
| 1159 | 2716 | 6708 | 3071 | 2672 | |
| 1160 | 2716 | 6709 | 3072 | 2672 | |
| 1161 | 2717 | 6809 | 3072 | 2673 | |
| 1162 | 2717 | 6831 | 3073 | 2673 | |
| 1163 | 2718 | 6832 | 3073 | 2674 | |
| 1164 | 2718 | 6864 | 3074 | 2674 | |
| 1165 | 2719 | 6866 | 3074 | 2675 | |
| 1166 | 2719 | 7089 | 3075 | 2675 | |
| 1167 | 2720 | 7157 | 3075 | 2676 | |
| 6015 | 2720 | 7159 | 3076 | 2676 | |
| 6029 | 2721 | 7173 | 3076 | 2677 | |
| 6045 | 2721 | 7176 | 3077 | 2677 | |
| 6077 | 2722 | 7293 | 3077 | 2678 | |
| 6129 | 2722 | 7295 | 3078 | 2678 | |
| 6144 | 2723 | 7343 | 3078 | 2679 | |
| 6164 | 2723 | 7393 | 3079 | 2680 | |
| 6201 | 2724 | 7394 | 3079 | 2680 | |
| 6227 | 2724 | 7425 | 3080 | 2681 | |
| 6244 | 2725 | 7426 | 3080 | 2681 | |
| 6250 | 2725 | 7444 | 3081 | 2682 | |
| 6264 | 2726 | 7445 | 3081 | 2682 | |
| 6289 | 2726 | 7476 | 3082 | 2683 | |
| 6304 | 2727 | 7478 | 3082 | 2683 | |
| 6316 | 2727 | 7496 | 3083 | 2684 | |
| 6384 | 2728 | 7497 | 3083 | 2684 | |
| 6421 | 2728 | 7537 | 3084 | 2685 | |
| 6441 | 2729 | 7539 | 3084 | 2685 | |
| 6492 | 2729 | 2780 | 3085 | 2686 | |
| 6514 | 2730 | 2780 | 3085 | 2686 | |
| 6530 | 2730 | 2781 | 3086 | 2687 | |

TABLE A5-continued

Exemplary gene modifying polypeptides comprising an AVIRE RT domain or an MLVMS RT domain.

| AVIRE SEQ ID NOs: | MLVMS SEQ ID NOs: | | |
|---|---|---|---|
| 6569 | 2731 | 2781 | 3086 | 2687 |
| 6584 | 2731 | 2782 | 3087 | 2688 |
| 6621 | 2732 | 2782 | 3087 | 2688 |
| 6651 | 2732 | 2783 | 3088 | 2689 |
| 6659 | 2733 | 2783 | 3088 | 2689 |
| 6683 | 2734 | 2784 | 3089 | 2690 |
| 6703 | 2734 | 2784 | 3089 | 2690 |
| 6727 | 2735 | 2785 | 3090 | 2691 |
| 6732 | 2735 | 2785 | 3090 | 2692 |
| 6745 | 2736 | 2786 | 3091 | 2692 |
| 6755 | 2736 | 2786 | 3091 | 2693 |
| 6784 | 2737 | 2787 | 3092 | 2693 |
| 6817 | 2737 | 2787 | 3092 | 2694 |
| 6823 | 2738 | 2788 | 3093 | 2694 |
| 6841 | 2739 | 2788 | 3093 | 2695 |
| 6871 | 2740 | 2789 | 3094 | 2695 |
| 6885 | 2740 | 2789 | 3095 | 2696 |
| 6898 | 2741 | 2790 | 3095 | 2696 |
| 6908 | 2741 | 2790 | 3096 | 2697 |
| 6933 | 2742 | 2791 | 3096 | 2697 |
| 6971 | 2742 | 2791 | 3097 | 2698 |
| 7009 | 2743 | 2792 | 3097 | 2698 |
| 7018 | 2743 | 2792 | 3098 | 2699 |
| 7045 | 2744 | 2793 | 3098 | 2699 |
| 7053 | 2744 | 2793 | 3099 | 2700 |
| 7068 | 2745 | 2794 | 3099 | 2700 |
| 7079 | 2745 | 2794 | 3100 | 2701 |
| 7096 | 2746 | 2795 | 3100 | 2701 |
| 7104 | 2746 | 2795 | 3101 | 2702 |
| 7122 | 2747 | 2796 | 3101 | 2702 |
| 7151 | 2747 | 2796 | 3102 | 2703 |
| 7163 | 2748 | 2797 | 3102 | 2703 |
| 7181 | 2748 | 2797 | 3103 | 2862 |
| 7244 | 2749 | 2798 | 3103 | 2862 |
| 7273 | 2750 | 2798 | 3104 | 2863 |
| 7319 | 2750 | 2799 | 3104 | 2863 |
| 7336 | 2751 | 2799 | 3105 | 2864 |
| 7380 | 2751 | 2800 | 3105 | 2864 |
| 7402 | 2752 | 2800 | 3106 | 2865 |
| 7462 | 2752 | 2801 | 3106 | 2865 |
| 7487 | 2753 | 2801 | 3107 | 2866 |
| 7525 | 2753 | 2802 | 3107 | 2866 |
| 7569 | 2754 | 2802 | 3108 | 2867 |
| 7626 | 2754 | 2803 | 3108 | 2867 |
| 7689 | 2755 | 2803 | 3109 | 2868 |
| 7707 | 2755 | 2804 | 3109 | 2868 |
| 7721 | 2756 | 2804 | 3110 | 2869 |
| 1371 | 2756 | 2805 | 3110 | 2869 |
| 1372 | 2757 | 2805 | 3111 | 2870 |
| 1373 | 2758 | 2806 | 3111 | 2870 |
| 1374 | 2758 | 2806 | 3112 | 2871 |
| 1375 | 2759 | 2807 | 3112 | 2871 |
| 1376 | 2759 | 2807 | 3113 | 2872 |
| 1377 | 2760 | 2808 | 3113 | 2872 |
| 1378 | 2760 | 2808 | 3114 | 2873 |
| 1379 | 2761 | 2809 | 3114 | 2873 |
| 1380 | 2761 | 2809 | 3115 | 2874 |
| 1381 | 2762 | 2810 | 3115 | 2874 |
| 1382 | 2762 | 2810 | 3116 | 2875 |
| 1383 | 2763 | 2811 | 3116 | 2875 |
| 1384 | 2763 | 2811 | 3117 | 2876 |
| 1385 | 2764 | 2812 | 3117 | 2876 |
| 1386 | 2764 | 2812 | 3118 | 2877 |
| 1387 | 2765 | 2813 | 3118 | 2877 |
| 1388 | 2765 | 2813 | 3119 | 2878 |
| 1389 | 2766 | 2814 | 3119 | 2878 |
| 1390 | 2766 | 2814 | 3120 | 2879 |
| 1391 | 2767 | 2815 | 3120 | 2879 |
| 1392 | 2767 | 2815 | 3121 | 2880 |
| 1393 | 2768 | 2816 | 3121 | 2880 |
| 1394 | 2768 | 2816 | 3122 | 2881 |
| 1395 | 2769 | 2817 | 3122 | 2881 |
| 1396 | 2769 | 2817 | 3123 | 2882 |
| 1397 | 2770 | 2818 | 3123 | 2882 |
| 1398 | 2770 | 2818 | 3124 | 2883 |
| 1399 | 2771 | 2819 | 3124 | 2883 |
| 1400 | 2771 | 2819 | 3125 | 2884 |
| 1401 | 2772 | 2820 | 3125 | 2884 |
| 1402 | 2773 | 2820 | 3126 | 2885 |
| 1403 | 2773 | 2821 | 3126 | 2885 |
| 1404 | 2774 | 2821 | 3127 | 2886 |
| 1405 | 2774 | 2822 | 3127 | 2886 |
| 1406 | 2775 | 2822 | 3128 | 2887 |
| 1407 | 2775 | 2823 | 3128 | 2887 |
| 1408 | 2776 | 2823 | 3129 | 2888 |
| 1409 | 2776 | 2824 | 3129 | 2888 |
| 1410 | 2777 | 2824 | 3130 | 2889 |
| 1411 | 2777 | 2825 | 3130 | 2889 |
| 1412 | 2778 | 2825 | 3131 | 2890 |
| 1413 | 2779 | 2826 | 3131 | 2890 |
| 1414 | 2779 | 2826 | 3132 | 2891 |
| 1415 | 2965 | 2827 | 3133 | 2891 |
| 1416 | 2965 | 2827 | 3133 | 2892 |
| 1417 | 2966 | 2828 | 3134 | 2893 |
| 1418 | 2966 | 2828 | 3134 | 2893 |
| 1419 | 2967 | 2829 | 3135 | 2894 |
| 1420 | 2968 | 2829 | 3135 | 2894 |
| 1421 | 2968 | 2830 | 3136 | 2895 |
| 1422 | 2969 | 2830 | 3136 | 2895 |
| 1423 | 2969 | 2831 | 6181 | 2896 |
| 1424 | 2970 | 2831 | 6183 | 2896 |
| 1425 | 2970 | 2832 | 6284 | 2897 |
| 1426 | 2971 | 2832 | 6285 | 2897 |
| 1427 | 2971 | 2833 | 6760 | 2898 |
| 1428 | 2972 | 2833 | 6761 | 2898 |
| 1429 | 2972 | 2834 | 7036 | 2899 |
| 1430 | 2973 | 2834 | 7038 | 2899 |
| 1431 | 2974 | 2835 | 7158 | 2900 |
| 1432 | 2974 | 2835 | 7160 | 2900 |
| 1433 | 2975 | 2836 | 2610 | 2901 |
| 1434 | 2976 | 2836 | 2610 | 2901 |
| 1435 | 2976 | 2837 | 2611 | 2902 |
| 1436 | 2977 | 2837 | 2611 | 2902 |
| 1437 | 2977 | 2838 | 2612 | 2903 |
| 1439 | 2978 | 2838 | 2612 | 2903 |
| 1440 | 2978 | 2839 | 2613 | 2904 |
| 1441 | 2979 | 2839 | 2613 | 2904 |
| 1442 | 2979 | 2840 | 2614 | 2905 |
| 1443 | 2980 | 2840 | 2614 | 2905 |
| 1444 | 2980 | 2841 | 2615 | 2906 |
| 1445 | 2981 | 2841 | 2615 | 2906 |
| 1446 | 2981 | 2842 | 2616 | 2907 |
| 1447 | 2982 | 2842 | 2616 | 2907 |
| 6001 | 2982 | 2843 | 2617 | 2908 |
| 6030 | 2983 | 2843 | 2617 | 2908 |
| 6078 | 2983 | 2844 | 2618 | 2909 |
| 6108 | 2984 | 2844 | 2618 | 2909 |
| 6130 | 2985 | 2845 | 2619 | 2910 |
| 6165 | 2985 | 2845 | 2619 | 2910 |
| 6265 | 2986 | 2846 | 2620 | 2911 |
| 6275 | 2987 | 2846 | 2620 | 2911 |
| 6305 | 2987 | 2847 | 2621 | 2912 |
| 6329 | 2988 | 2847 | 2621 | 2912 |
| 6370 | 2988 | 2848 | 2622 | 2913 |
| 6385 | 2989 | 2848 | 2622 | 2913 |
| 6404 | 2989 | 2849 | 2623 | 2914 |
| 6531 | 2990 | 2849 | 2623 | 2914 |
| 6585 | 2990 | 2850 | 2624 | 2915 |
| 6622 | 2991 | 2850 | 2624 | 2915 |
| 6652 | 2991 | 2851 | 2625 | 2916 |
| 6733 | 2992 | 2851 | 2625 | 2916 |
| 6756 | 2992 | 2852 | 2626 | 2917 |
| 6765 | 2993 | 2852 | 2626 | 2917 |
| 6798 | 2993 | 2853 | 2627 | 2918 |
| 6824 | 2994 | 2853 | 2627 | 2919 |
| 6972 | 2994 | 2854 | 2628 | 2919 |
| 7046 | 2995 | 2854 | 2628 | 2920 |
| 7054 | 2995 | 2855 | 2629 | 2920 |
| 7069 | 2996 | 2855 | 2629 | 2921 |
| 7080 | 2996 | 2856 | 2630 | 2921 |

TABLE A5-continued

Exemplary gene modifying polypeptides comprising an AVIRE RT domain or an MLVMS RT domain.

| AVIRE SEQ ID NOs: | MLVMS SEQ ID NOs: | | | |
|---|---|---|---|---|
| 7105 | 2997 | 2856 | 2630 | 2922 |
| 7123 | 2998 | 2857 | 2631 | 2922 |
| 7143 | 2998 | 2857 | 2631 | 2923 |
| 7152 | 2999 | 2858 | 2632 | 2923 |
| 7204 | 2999 | 2858 | 2632 | 2924 |
| 7320 | 3001 | 2859 | 2633 | 2924 |
| 7351 | 3001 | 2859 | 2633 | 2925 |
| 7381 | 3002 | 2860 | 2634 | 2925 |
| 7403 | 3002 | 2860 | 2634 | 2926 |
| 7438 | 3003 | 2861 | 2635 | 2926 |
| 7488 | 3003 | 2861 | 2635 | 2927 |
| 7500 | 3004 | 3035 | 2636 | 2927 |
| 7526 | 3004 | 3036 | 2636 | 2928 |
| 7588 | 3005 | 3036 | 2637 | 2928 |
| 7612 | 3005 | 3037 | 2637 | 2929 |
| 7627 | 3006 | 3037 | 2638 | 2929 |

Systems

In an aspect, the disclosure relates to a system comprising nucleic acid molecule encoding a gene modifying polypeptide (e.g., as described herein) and a template nucleic acid (e.g., a template RNA, e.g., as described herein). In certain embodiments, the nucleic acid molecule encoding the gene modifying polypeptide comprises one or more silent mutations in the coding region (e.g., in the sequence encoding the RT domain) relative to a nucleic acid molecule as described herein. In certain embodiments, the system further comprises a gRNA (e.g., a gRNA that binds to a polypeptide that induces a nick, e.g., in the opposite strand of the target DNA bound by the gene modifying polypeptide).

In certain embodiments, the nucleic acid molecule encoding the gene modifying polypeptide encodes a polypeptide having an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide encodes a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide encodes a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide encodes a polypeptide as listed in any of Tables A1, T1, T2, or D1-D12, or an amino acid sequence having at least 70%, 75%, 80%, 85%, 90%, 95%, or 99% identity thereto.

In certain embodiments, the nucleic acid molecule encoding the gene modifying polypeptide comprises a sequence encoding a portion of an amino acid sequence selected from SEQ ID NOs: 1-7743, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of an amino acid sequence selected from SEQ ID NOs: 6001-7743, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of an amino acid sequence selected from SEQ ID NOs: 4501-4541, wherein the portion comprises a linker and RT domain, or an amino acid sequence having at least 70%, 75%, 80%, 85%, 90%, 95%, or 99% identity to said portion. In certain embodiments, the nucleic acid molecule encoding the gene modifying polypeptide comprises a sequence encoding a portion of a polypeptide listed in any of Tables A1, T1, T2, or D1-D12, wherein the portion comprises a linker and RT domain, or an amino acid sequence having at least 70%, 75%, 80%, 85%, 90%, 95%, or 99% identity to said portion.

In certain embodiments, the nucleic acid molecule encoding the gene modifying polypeptide comprises a sequence encoding the linker of an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the linker of a polypeptide as listed in any of Tables A1, T1, T2, or D1-D12, or an amino acid sequence having at least 70%, 75%, 80%, 85%, 90%, 95%, or 99% identity thereto.

In certain embodiments, the nucleic acid molecule encoding the gene modifying polypeptide comprises a sequence encoding the RT domain of an amino acid sequence selected from SEQ ID NOs: 1-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the nucleic acid molecule encoding the gene modifying polypeptide comprises a sequence encoding the RT domain of a polypeptide as listed in any of Tables A1, T1, T2, or D1-D12, or an amino acid sequence having at least 70%, 75%, 80%, 85%, 90%, 95%, or 99% identity thereto.

In an aspect, the disclosure relates to a system comprising a gene modifying polypeptide (e.g., as described herein) and a template nucleic acid (e.g., a template RNA, e.g., as described herein).

In certain embodiments, the gene modifying polypeptide comprises a polypeptide having an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises a polypeptide as listed in any of Tables A1, T1, T2, or D1-D12, or an amino acid sequence having at least 70%, 75%, 80%, 85%, 90%, 95%, or 99% identity thereto.

In certain embodiments, the gene modifying polypeptide comprises a portion of an amino acid sequence selected from SEQ ID NOs: 1-7743, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of an amino acid sequence selected from SEQ ID NOs: 6001-7743, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of an amino acid sequence selected from SEQ ID NOs: 4501-4541, wherein the portion comprises a linker and RT domain, or an amino acid sequence having at least 70%, 75%, 80%, 85%, 90%, 95%, or 99% identity to said portion. In certain embodiments, the gene modifying polypeptide comprises a portion of a polypeptide listed in any of Tables A1, T1, T2, or D1-D12, wherein the portion comprises a linker and RT domain, or an amino acid sequence having at least 70%, 75%, 80%, 85%, 90%, 95%, or 99% identity to said portion.

In certain embodiments, the gene modifying polypeptide comprises the linker of an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a sequence encoding the linker of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a sequence encoding the linker of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises the linker of a polypeptide as listed in any of Tables A1, T1, T2, or D1-D12, or an amino acid sequence having at least 70%, 75%, 80%, 85%, 90%, 95%, or 99% identity thereto.

In certain embodiments, the gene modifying polypeptide comprises the RT domain of an amino acid sequence selected from SEQ ID NOs: 1-7743, or an amino acid sequence having at least 70%, 75%, 80%, 85%, 90%, 95%, or 99% identity thereto. In certain embodiments, the gene modifying polypeptide comprises a sequence encoding the RT domain of a polypeptide having an amino acid sequence selected from SEQ ID NOs: 6001-7743, or an amino acid sequence having at least 70%, 75%, 80%, 85%, 90%, 95%, or 99% identity thereto. In certain embodiments, the gene modifying polypeptide comprises a sequence encoding the RT domain of a polypeptide having an amino acid sequence selected from SEQ ID NOs: 4501-4541, or an amino acid sequence having at least 70%, 75%, 80%, 85%, 90%, 95%, or 99% identity thereto. In certain embodiments, the gene modifying polypeptide comprises the RT domain of a polypeptide as listed in any of Tables A1, T1, T2, or D1-D12, or an amino acid sequence having at least 70%, 75%, 80%, 85%, 90%, 95%, or 99% identity thereto.

Lengthy table referenced here

US12024728-20240702-T00001

Please refer to the end of the specification for access instructions.

Localization Sequences for Gene Modifying Systems

In certain embodiments, a gene editor system RNA further comprises an intracellular localization sequence, e.g., a nuclear localization sequence (NLS). In some embodiments, a gene modifying polypeptide comprises an NLS as comprised in SEQ ID NO: 4000 and/or SEQ ID NO: 4001, or an NLS having an amino acid sequence having at least 75%, 80%, 85%, 90%, 95%, 96%, 97%, 98%, or 99% identity thereto.

The nuclear localization sequence may be an RNA sequence that promotes the import of the RNA into the nucleus. In certain embodiments the nuclear localization signal is located on the template RNA. In certain embodiments, the gene modifying polypeptide is encoded on a first RNA, and the template RNA is a second, separate, RNA, and the nuclear localization signal is located on the template RNA and not on an RNA encoding the gene modifying polypeptide. While not wishing to be bound by theory, in some embodiments, the RNA encoding the gene modifying polypeptide is targeted primarily to the cytoplasm to promote its translation, while the template RNA is targeted primarily to the nucleus to promote insertion into the genome. In some embodiments the nuclear localization signal is at the 3' end, 5' end, or in an internal region of the template RNA. In some embodiments the nuclear localization signal is 3' of the heterologous sequence (e.g., is directly 3' of the heterologous sequence) or is 5' of the heterologous sequence (e.g., is directly 5' of the heterologous sequence). In some embodiments the nuclear localization signal is placed outside of the 5' UTR or outside of the 3' UTR of the template RNA. In some embodiments the nuclear localization signal is placed between the 5' UTR and the 3' UTR, wherein optionally the nuclear localization signal is not transcribed with the transgene (e.g., the nuclear localization signal is an anti-sense orientation or is downstream of a transcriptional termination signal or polyadenylation signal). In some embodiments the nuclear localization sequence is situated inside of an intron. In some embodiments a plurality of the same or different nuclear localization signals are in the RNA, e.g., in the template RNA. In some embodiments the nuclear localization signal is less than 5, 10, 25, 50, 75, 100, 150, 200, 250, 300, 350, 400, 450, 500, 600, 700, 800, 900 or 1000 bp in length. Various RNA nuclear localization sequences can be used. For example, Lubelsky and Ulitsky, *Nature* 555 (107-111), 2018 describe RNA sequences which drive RNA localization into the nucleus. In some embodiments, the nuclear localization signal is a SINE-derived nuclear RNA localization (SIRLOIN) signal. In some embodiments the nuclear localization signal binds a nuclear-enriched protein. In some embodiments the nuclear localization signal binds the HNRNPK protein. In some embodiments the nuclear localization signal is rich in pyrimidines, e.g., is a C/T rich, C/U rich, C rich, T rich, or U rich region. In some embodiments the nuclear localization signal is derived from a long non-coding RNA. In some embodiments the nuclear localization signal is derived from MALAT1 long non-coding RNA or is the 600 nucleotide M region of MALAT1 (described in Miyagawa et al., RNA 18, (738-751), 2012). In some embodiments the nuclear localization signal is derived from BORG long non-coding RNA or is a AGCCC motif (described in Zhang et al., *Molecular and Cellular Biology* 34, 2318-2329 (2014). In some embodiments the nuclear localization sequence is described in Shukla et al., *The EMBO Journal* e98452 (2018). In some embodiments the nuclear localization signal is derived from a retrovirus.

In some embodiments, a polypeptide described herein comprises one or more (e.g., 2, 3, 4, 5) nuclear targeting sequences, for example a nuclear localization sequence (NLS). In some embodiments, the NLS is a bipartite NLS. In some embodiments, an NLS facilitates the import of a protein comprising an NLS into the cell nucleus. In some embodiments, the NLS is fused to the N-terminus of a gene modifying polypeptide as described herein. In some embodiments, the NLS is fused to the C-terminus of the gene modifying polypeptide. In some embodiments, the NLS is fused to the N-terminus or the C-terminus of a Cas domain. In some embodiments, a linker sequence is disposed between the NLS and the neighboring domain of the gene modifying polypeptide.

In some embodiments, an NLS comprises the amino acid sequence MDSLLMNRRKFLYQFKNVRWAKGRRETYLC (SEQ ID NO: 5009), PKKRKVEGADKRTADGSEFESPKKKRKV (SEQ ID NO: 5010), RKSGKIAAIWKRPRKPKKKRKV (SEQ ID NO: 5011) KRTADGSEFESPKKKRKV (SEQ ID NO: 5012), KKTELQTTNAENKTKKL (SEQ ID NO: 5013), or KRGINDRNFWRGENGRKTR (SEQ ID NO: 5014), KRPAATKKAGQAKKKK (SEQ ID NO: 5015), PAAKRVKLD (SEQ ID NO: 4644), KRTADGSEFEKRTADGSEFESPKKKAKVE (SEQ ID NO: 4649), KRTADGSEFE (SEQ ID NO: 4650), KRTADGSEFESPKKKAKVE (SEQ ID NO: 4651), AGKRTADGSEFEKRTADGSEFESPKKKAKVE (SEQ ID NO: 4001) or a functional fragment or variant thereof. Exemplary NLS sequences are also described in PCT/EP2000/011690, the contents of which are incorporated herein by reference for their disclosure of exemplary nuclear localization sequences. In some embodiments, an NLS comprises an amino acid sequence as disclosed in Table 11. An NLS of this table may be utilized with one or more copies in a polypeptide in one or more locations in a polypeptide, e.g., 1, 2, 3 or more copies of an NLS in an N-terminal domain, between peptide domains, in a C-terminal domain, or in a combination of locations, in order to improve subcellular localization to the nucleus. Multiple unique sequences may be used within a single polypeptide. Sequences may be naturally monopartite or bipartite, e.g., having one or two stretches of basic amino acids, or may be used as chimeric bipartite sequences. Sequence references correspond to UniProt accession numbers, except where indicated as SeqNLS for sequences mined using a subcellular localization prediction algorithm (Lin et al BMC Bioinformat 13:157 (2012), incorporated herein by reference in its entirety).

TABLE 11

Exemplary nuclear localization signals for use in gene modifying systems

| Sequence | Sequence References | SEQ ID No. |
|---|---|---|
| AHFKISGEKRPSTDPGKKAKNPKKKKKDP | Q76IQ7 | 5223 |
| AHRAKKMSKTHA | P21827 | 5224 |
| ASPEYVNLPINGNG | SeqNLS | 5225 |
| CTKRPRW | O88622, Q86W56, Q9QYM2, O02776 | 5226 |
| DKAKRVSRNKSEKKRR | O15516, Q5RAK8, Q91YB2, Q91YB0, Q8QGQ6, O08785, Q9WVS9, Q6YGZ4 | 5227 |
| EELRLKEELLKGIYA | Q9QY16, Q9UHL0, Q2TBP1, Q9QY15 | 5228 |
| EEQLRRRKNSRLNNTG | G5EFF5 | 5229 |
| EVLKVIRTGKRKKKAWKRMVTKVC | SeqNLS | 5230 |
| HHHHHHHHHHHQPH | Q63934, G3V7L5, Q12837 | 5231 |
| HKKKHPDASVNFSEFSK | P10103, Q4R844, P12682, B0CM99, A9RA84, Q6YKA4, P09429, P63159, Q08IE6, P63158, Q9YH06, B1MTB0 | 5232 |
| HKRTKK | Q2R2D5 | 5233 |
| IINGRKLKLKKSRRRSSQTSNNSFTSRRS | SeqNLS | 5234 |
| KAEQERRK | Q8LH59 | 5235 |
| KEKRKRREELFIEQKKRK | SeqNLS | 5236 |
| KKGKDEWFSRGKKP | P30999 | 5237 |
| KKGPSVQKRKKT | Q6ZN17 | 5238 |
| KKKTVINDLLHYKKEK | SeqNLS, P32354 | 5239 |
| KKNGGKGKNKPSAKIKK | SeqNLS | 5240 |

TABLE 11-continued

Exemplary nuclear localization signals for use in gene modifying systems

| Sequence | Sequence References | SEQ ID No. |
|---|---|---|
| KKPKWDDFKKKKK | Q15397, Q8BKS9, Q562C7 | 5241 |
| KKRKKD | SeqNLS, Q91Z62, Q1A730, Q969P5, Q2KHT6, Q9CPU7 | 5242 |
| KKRRKRRRK | SeqNLS | 5243 |
| KKRRRRARK | Q9UMS6, D4A702, Q91YE8 | 5244 |
| KKSKRGR | Q9UBS0 | 5245 |
| KKSRKRGS | B4FG96 | 5246 |
| KKSTALSRELGKIMRRR | SeqNLS, P32354 | 5247 |
| KKSYQDPEIIAHSRPRK | Q9U7C9 | 5248 |
| KKTGKNRKLKSKRVKTR | Q9Z301, O54943, Q8K3T2 | 5249 |
| KKVSIAGQSGKLWRWKR | Q6YUL8 | 5250 |
| KKYENVVIKRSPRKRGRPRK | SeqNLS | 5251 |
| KNKKRK | SeqNLS | 5252 |
| KPKKKR | SeqNLS | 5253 |
| KRAMKDDSHGNSTSPKRRK | Q0E671 | 5254 |
| KRANSNLVAAYEKAKKK | P23508 | 5255 |
| KRASEDTTSGSPPKKSSAGPKR | Q9BZZ5, Q5R644 | 5256 |
| KRFKRRWMVRKMKTKK | SeqNLS | 5257 |
| KRGLNSSFETSPKKVK | Q8IV63 | 5258 |
| KRGNSSIGPNDLSKRKQRKK | SeqNLS | 5259 |
| KRIHSVSLSQSQIDPSKKVKRAK | SeqNLS | 5260 |
| KRKGKLKNKGSKRKK | O15381 | 5261 |
| KRRRRRREKRKR | Q96GM8 | 5262 |
| KRSNDRTYSPEEEKQRRA | Q91ZF2 | 5263 |
| KRTVATNGDASGAHRAKKMSK | SeqNLS | 5264 |
| KRVYNKGEDEQEHLPKGKKR | SeqNLS | 5265 |
| KSGKAPRRRAVSMDNSNK | Q9WVH4, O43524 | 5266 |
| KVNFLDMSLDDIIYKELE | Q9P127 | 5267 |
| KVQHRIAKKTTRRRR | Q9DXE6 | 5268 |
| LSPSLSPL | Q9Y261, P32182, P35583 | 5269 |
| MDSLLMNRRKFLYQFKNVRWAKGRRETYLC | Q9GZX7 | 5270 |
| MPQNEYIELHRKRYGYRLDYHEKKRKKESREAHER SKKAKKMIGLKAKLYHK | SeqNLS | 5271 |
| MVQLRPRASR | SeqNLS | 5272 |
| NNKLLAKRRKGGASPKDDPMDDIK | Q965G5 | 5273 |
| NYKRPMDGTYGPPAKRHEGE | O14497, A2BH40 | 5274 |
| PDTKRAKLDSSETTMVKKK | SeqNLS | 5275 |
| PEKRTKI | SeqNLS | 5276 |
| PGGRGKKK | Q719N1, Q9UBP0, A2VDN5 | 5277 |

TABLE 11-continued

Exemplary nuclear localization signals for use in gene modifying systems

| Sequence | Sequence References | SEQ ID No. |
| --- | --- | --- |
| PGKMDKGEHRQERRDRPY | Q01844, Q61545 | 5278 |
| PKKGDKYDKTD | Q45FA5 | 5279 |
| PKKKSRK | O35914, Q01954 | 5280 |
| PKKNKPE | Q22663 | 5281 |
| PKKRAKV | P04295, P89438 | 5282 |
| PKPKKLKVE | P55263, P55262, P55264, Q64640 | 5283 |
| PKRGRGR | Q9FYS5, Q43386 | 5284 |
| PKRRLVDDA | P0C797 | 5285 |
| PKRRRTY | SeqNLS | 5286 |
| PLFKRR | A8X6H4, Q9TXJ0 | 5287 |
| PLRKAKR | Q86WB0, Q5R8V9 | 5288 |
| PPAKRKCIF | Q6AZ28, O75928, Q8C5D8 | 5289 |
| PPARRRL | Q8NAG6 | 5290 |
| PPKKKRKV | Q3L6L5, P03070, P14999, P03071 | 5291 |
| PPNKRMKVKH | Q8BN78 | 5292 |
| PPRIYPQLPSAPT | P0C799 | 5293 |
| PQRSPFPKSSVKR | SeqNLS | 5294 |
| PRPRKVPR | P0C799 | 5295 |
| PRRRVQRKR | SeqNLS, Q5R448, Q5TAQ9 | 5296 |
| PRRVRLK | Q58DJ0, P56477, Q13568 | 5297 |
| PSRKRPR | Q62315, Q5F363, Q92833 | 5298 |
| PSSKKRKV | SeqNLS | 5299 |
| PTKKRVK | P07664 | 5300 |
| QRPGPYDRP | SeqNLS | 5301 |
| RGKGGKGLGKGGAKRHRK | SeqNLS | 5302 |
| RKAGKGGGHKTTKKRSAKDEKVP | B4FG96 | 5303 |
| RKIKLKRAK | A1L3G9 | 5304 |
| RKIKRKRAK | B9X187 | 5305 |
| RKKEAPGPREELRSRGR | O35126, P54258, Q5IS70, P54259 | 5306 |
| RKKRKGK | SeqNLS, Q29243, Q62165, Q28685, O18738, Q9TSZ6, Q14118 | 5307 |
| RKKRRQRRR | P04326, P69697, P69698, P05907, P20879, P04613, P19553, P0C1J9, P20893, P12506, P04612, Q73370, P0C1K0, P05906, P35965, P04609, P04610, P04614, P04608, P05905 | 5308 |
| RKKSIPLSIKNLKRKHKRKKNKITR | Q9C0C9 | 5309 |
| RKLVKPKNTKMKTKLRTNPY | Q14190 | 5310 |
| RKRLILSDKGQLDWKK | SeqNLS, Q91Z62, Q1A730, Q2KHT6, Q9CPU7 | 5311 |
| RKRLKSK | Q13309 | 5312 |

TABLE 11-continued

Exemplary nuclear localization signals for use in gene modifying systems

| Sequence | Sequence References | SEQ ID No. |
| --- | --- | --- |
| RKRRVRDNM | Q8QPH4, Q809M7, A8C8X1, Q2VNC5, Q38SQ0, O89749, Q6DNQ9, Q809L9, Q0A429, Q20NV3, P16509, P16505, Q6DNQ5, P16506, Q6XT06, P26118, Q2ICQ2, Q2RCG8, Q0A2D0, Q0A2H9 Q9IQ46, Q809M3, Q6J847, Q6J856, B4URE4, A4GCM7, Q0A440, P26120, P16511, | 5313 |
| RKRSPKDKKEKDLDGAGKRRKT | Q7RTP6 | 5314 |
| RKRTPRVDGQTGENDMNKRRRK | O94851 | 5315 |
| RLPVRRRRRR | P04499, P12541, P03269, P48313, P03270 | 5316 |
| RLRFRKPKSK | P69469 | 5317 |
| RQQRKR | Q14980 | 5318 |
| RRDLNSSFETSPKKVK | Q8K3G5 | 5319 |
| RRDRAKLR | Q9SLB8 | 5320 |
| RRGDGRRR | Q80WE1, Q5R9B4, Q06787, P35922 | 5321 |
| RRGRKRKAEKQ | Q812D1, Q5XXA9, Q99JF8, Q8MJG1, Q66172, O75475 | 5322 |
| RRKKRR | Q0VD86, Q58DS6, Q5R6G2, Q9ERI5, Q6AYK2, Q6NYC1 | 5323 |
| RRKRSKSEDMDSVESKRRR | Q7TT18 | 5324 |
| RRKRSR | Q99PU7, D3ZHS6, Q92560, A2VDM8 | 5325 |
| RRPKGKTLQKRKPK | Q6ZN17 | 5326 |
| RRRGFERFGPDNMGRKRK | Q63014, Q9DBR0 | 5327 |
| RRRGKNKVAAQNCRK | SeqNLS | 5328 |
| RRRKRR | Q5FVH8, Q6MZT1, Q08DH5, Q8BQP9 | 5329 |
| RRRQKQKGGASRRR | SeqNLS | 5330 |
| RRRREGPRARRRR | P08313, P10231 | 5331 |
| RRTIRLKLVYDKCDRSCKIQKKNRNKCQYCRFHKCL SVGMSHNAIRFGRMPRSEKAKLKAE | SeqNLS | 5332 |
| RRVPQRKEVSRCRKCRK | Q5RJN4, Q32L09, Q8CAK3, Q9NUL5 | 5333 |
| RVGGRRQAVECIEDLLNEPGQPLDLSCKRPRP | P03255 | 5334 |
| RVVKLRIAP | P52639, Q8JMN0 | 5335 |
| RVVRRR | P70278 | 5336 |
| SKRKTKISRKTR | Q5RAY1, O00443 | 5337 |
| SYVKTVPNRTRTYIKL | P21935 | 5338 |
| TGKNEAKKRKIA | P52739, Q8K3J5, Q5RAU9 | 5339 |
| TLSPASSPSSVSCPVIPASTDESPGSALNI | SeqNLS | 5340 |
| VSKKQRTGKKIH | P52739, Q8K3J5, Q5RAU9 | 5341 |
| SPKKKRKVE | | 5342 |
| KRTAD GSEFE SPKKKRKVE | | 5343 |
| PAAKRVKLD | | 5344 |
| PKKKRKV | | 5345 |

TABLE 11-continued

Exemplary nuclear localization signals for use in gene modifying systems

| Sequence | Sequence References | SEQ ID No. |
|---|---|---|
| MDSLLMNRRKFLYQFKNVRWAKGRRETYLC | | 5346 |
| SPKKKRKVEAS | | 5347 |
| MAPKKKRKVGIHRGVP | | 5348 |
| KRTADGSEFEKRTADGSEFESPKKKAKVE | | 5349 |
| KRTADGSEFE | | 5350 |
| KRTADGSEFESPKKKAKVE | | 5351 |
| AGKRTADGSEFEKRTADGSEFESPKKKAKVE | | 4001 |

In some embodiments, the NLS is a bipartite NLS. A bipartite NLS typically comprises two basic amino acid clusters separated by a spacer sequence (which may be, e.g., about 10 amino acids in length). A monopartite NLS typically lacks a spacer. An example of a bipartite NLS is the nucleoplasmin NLS, having the sequence KR[PAATKKAGQA]KKKK (SEQ ID NO: 5015), wherein the spacer is bracketed. Another exemplary bipartite NLS has the sequence PKKKRKVEGADKRTADGSEFESPKKKRKV (SEQ ID NO: 5016). Exemplary NLSs are described in International Application W02020051561, which is herein incorporated by reference in its entirety, including for its disclosures regarding nuclear localization sequences.

In certain embodiments, a gene editor system polypeptide (e.g., a gene modifying polypeptide as described herein) further comprises an intracellular localization sequence, e.g., a nuclear localization sequence and/or a nucleolar localization sequence. The nuclear localization sequence and/or nucleolar localization sequence may be amino acid sequences that promote the import of the protein into the nucleus and/or nucleolus, where it can promote integration of heterologous sequence into the genome. In certain embodiments, a gene editor system polypeptide (e.g., (e.g., a gene modifying polypeptide as described herein) further comprises a nucleolar localization sequence. In certain embodiments, the gene modifying polypeptide is encoded on a first RNA, and the template RNA is a second, separate, RNA, and the nucleolar localization signal is encoded on the RNA encoding the gene modifying polypeptide and not on the template RNA. In some embodiments, the nucleolar localization signal is located at the N-terminus, C-terminus, or in an internal region of the polypeptide. In some embodiments, a plurality of the same or different nucleolar localization signals are used. In some embodiments, the nuclear localization signal is less than 5, 10, 25, 50, 75, or 100 amino acids in length. Various polypeptide nucleolar localization signals can be used. For example, Yang et al., *Journal of Biomedical Science* 22, 33 (2015), describe a nuclear localization signal that also functions as a nucleolar localization signal. In some embodiments, the nucleolar localization signal may also be a nuclear localization signal. In some embodiments, the nucleolar localization signal may overlap with a nuclear localization signal. In some embodiments, the nucleolar localization signal may comprise a stretch of basic residues. In some embodiments, the nucleolar localization signal may be rich in arginine and lysine residues. In some embodiments, the nucleolar localization signal may be derived from a protein that is enriched in the nucleolus. In some embodiments, the nucleolar localization signal may be derived from a protein enriched at ribosomal RNA loci. In some embodiments, the nucleolar localization signal may be derived from a protein that binds rRNA. In some embodiments, the nucleolar localization signal may be derived from MSP58. In some embodiments, the nucleolar localization signal may be a monopartite motif. In some embodiments, the nucleolar localization signal may be a bipartite motif. In some embodiments, the nucleolar localization signal may consist of a multiple monopartite or bipartite motifs. In some embodiments, the nucleolar localization signal may consist of a mix of monopartite and bipartite motifs. In some embodiments, the nucleolar localization signal may be a dual bipartite motif. In some embodiments, the nucleolar localization motif may be a KRASSQALG-TIPKRRSSSRFIKRKK (SEQ ID NO: 5017). In some embodiments, the nucleolar localization signal may be derived from nuclear factor-κB-inducing kinase. In some embodiments, the nucleolar localization signal may be an RKKRKKK motif (SEQ ID NO: 5018) (described in Birbach et al., Journal of Cell Science, 117 (3615-3624), 2004).

Evolved Variants of Gene Modifying Polypeptides and Systems

In some embodiments, the invention provides evolved variants of gene modifying polypeptides as described herein. Evolved variants can, in some embodiments, be produced by mutagenizing a reference gene modifying polypeptide, or one of the fragments or domains comprised therein. In some embodiments, one or more of the domains (e.g., the reverse transcriptase domain) is evolved. One or more of such evolved variant domains can, in some embodiments, be evolved alone or together with other domains. An evolved variant domain or domains may, in some embodiments, be combined with unevolved cognate component(s) or evolved variants of the cognate component(s), e.g., which may have been evolved in either a parallel or serial manner.

In some embodiments, the process of mutagenizing a reference gene modifying polypeptide, or fragment or domain thereof, comprises mutagenizing the reference gene modifying polypeptide or fragment or domain thereof. In embodiments, the mutagenesis comprises a continuous evolution method (e.g., PACE) or non-continuous evolution method (e.g., PANCE), e.g., as described herein. In some embodiments, the evolved gene modifying polypeptide, or a fragment or domain thereof, comprises one or more amino acid variations introduced into its amino acid sequence relative to the amino acid sequence of the reference gene modifying polypeptide, or fragment or domain thereof. In embodiments, amino acid sequence variations may include one or more mutated residues (e.g., conservative substitutions, non-conservative substitutions, or a combination thereof) within the amino acid sequence of a reference gene modifying polypeptide, e.g., as a result of a change in the nucleotide sequence encoding the gene modifying polypeptide that results in, e.g., a change in the codon at any particular position in the coding sequence, the deletion of one or more amino acids (e.g., a truncated protein), the insertion of one or more amino acids, or any combination of the foregoing. The evolved variant gene modifying polypeptide may include variants in one or more components or domains of the gene modifying polypeptide (e.g., variants introduced into a reverse transcriptase domain).

In some aspects, the disclosure provides gene modifying polypeptides, systems, kits, and methods using or comprising an evolved variant of a gene modifying polypeptide, e.g., employs an evolved variant of a gene modifying polypeptide or a gene modifying polypeptide produced or producible by PACE or PANCE. In embodiments, the unevolved reference gene modifying polypeptide is a gene modifying polypeptide as disclosed herein.

The term "phage-assisted continuous evolution (PACE)," as used herein, generally refers to continuous evolution that employs phage as viral vectors. Examples of PACE technology have been described, for example, in International PCT Application No. PCT/US 2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394,537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; and International PCT Application, PCT/US2016/027795, filed Apr. 15, 2016, published as WO 2016/168631 on Oct. 20, 2016, the entire contents of each of which are incorporated herein by reference.

The term "phage-assisted non-continuous evolution (PANCE)," as used herein, generally refers to non-continuous evolution that employs phage as viral vectors. Examples of PANCE technology have been described, for example, in Suzuki T. et al, Crystal structures reveal an elusive functional domain of pyrrolysyl-tRNA synthetase, Nat Chem Biol. 13(12): 1261-1266 (2017), incorporated herein by reference in its entirety. Briefly, PANCE is a technique for rapid in vivo directed evolution using serial flask transfers of evolving selection phage (SP), which contain a gene of interest to be evolved, across fresh host cells (e.g., *E. coli* cells). Genes inside the host cell may be held constant while genes contained in the SP continuously evolve. Following phage growth, an aliquot of infected cells may be used to transfect a subsequent flask containing host *E. coli*. This process can be repeated and/or continued until the desired phenotype is evolved, e.g., for as many transfers as desired.

Methods of applying PACE and PANCE to gene modifying polypeptides may be readily appreciated by the skilled artisan by reference to, inter alia, the foregoing references. Additional exemplary methods for directing continuous evolution of genome-modifying proteins or systems, e.g., in a population of host cells, e.g., using phage particles, can be applied to generate evolved variants of gene modifying polypeptides, or fragments or subdomains thereof. Non-limiting examples of such methods are described in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394,537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; International Application No. PCT/US2019/37216, filed Jun. 14, 2019, International Patent Publication WO 2019/023680, published Jan. 31, 2019, International PCT Application, PCT/US2016/027795, filed Apr. 15, 2016, published as WO 2016/168631 on Oct. 20, 2016, and International Patent Publication No. PCT/US2019/47996, filed Aug. 23, 2019, each of which is incorporated herein by reference in its entirety.

In some non-limiting illustrative embodiments, a method of evolution of a evolved variant gene modifying polypeptide, of a fragment or domain thereof, comprises: (a) contacting a population of host cells with a population of viral vectors comprising the gene of interest (the starting gene modifying polypeptide or fragment or domain thereof), wherein: (1) the host cell is amenable to infection by the viral vector; (2) the host cell expresses viral genes required for the generation of viral particles; (3) the expression of at least one viral gene required for the production of an infectious viral particle is dependent on a function of the gene of interest; and/or (4) the viral vector allows for expression of the protein in the host cell, and can be replicated and packaged into a viral particle by the host cell. In some embodiments, the method comprises (b) contacting the host cells with a mutagen, using host cells with mutations that elevate mutation rate (e.g., either by carrying a mutation plasmid or some genome modification—e.g., proofing-impaired DNA polymerase, SOS genes, such as UmuC, UmuD', and/or RecA, which mutations, if plasmid-bound, may be under control of an inducible promoter), or a combination thereof. In some embodiments, the method comprises (c) incubating the population of host cells under conditions allowing for viral replication and the production of viral particles, wherein host cells are removed from the host cell population, and fresh, uninfected host cells are introduced into the population of host cells, thus replenishing the population of host cells and creating a flow of host cells. In some embodiments, the cells are incubated under conditions allowing for the gene of interest to acquire a mutation. In some embodiments, the method further comprises (d) isolating a mutated version of the viral vector, encoding an evolved gene product (e.g., an evolved variant gene modifying polypeptide, or fragment or domain thereof), from the population of host cells.

The skilled artisan will appreciate a variety of features employable within the above-described framework. For example, in some embodiments, the viral vector or the phage is a filamentous phage, for example, an M13 phage, e.g., an M13 selection phage. In certain embodiments, the gene required for the production of infectious viral particles is the M13 gene III (gIII). In embodiments, the phage may lack a functional gIII, but otherwise comprise gI, gII, gIV, gV, gVI, gVII, gVIII, gIX, and a gX. In some embodiments, the generation of infectious VSV particles involves the envelope protein VSV-G. Various embodiments can use different retroviral vectors, for example, Murine Leukemia Virus vectors, or Lentiviral vectors. In embodiments, the retroviral vectors can efficiently be packaged with VSV-G envelope protein, e.g., as a substitute for the native envelope protein of the virus.

In some embodiments, host cells are incubated according to a suitable number of viral life cycles, e.g., at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles, which in on illustrative and non-limiting examples of M13 phage is 10-20 minutes per virus life cycle. Similarly, conditions can be modulated to adjust the time a host cell remains in a population of host cells, e.g., about 10, about 11, about 12, about 13, about 14, about 15, about 16, about 17, about 18, about 19, about 20, about 21, about 22, about 23, about 24, about 25, about 30, about 35, about 40, about 45, about 50, about 55, about 60, about 70, about 80, about 90, about 100, about 120, about 150, or about 180 minutes. Host cell populations can be controlled in part by density of the host cells, or, in some embodiments, the host cell density in an inflow, e.g., $10^3$ cells/ml, about $10^4$ cells/ml, about $10^5$ cells/ml, about $5\text{-}10^5$ cells/ml, about $10^6$ cells/ml, about $5\text{-}10^6$ cells/ml, about $10^7$ cells/ml, about $5\text{-}10^7$ cells/ml, about $10^8$ cells/ml, about $5\text{-}10^8$ cells/ml, about $10^9$ cells/ml, about $5\text{-}10^9$ cells/ml, about $10^{10}$ cells/ml, or about $5\text{-}10^{10}$ cells/ml.

Inteins

In some embodiments, as described in more detail below, an intein-N (intN) domain may be fused to the N-terminal portion of a first domain of a gene modifying polypeptide described herein, and an intein-C (intC) domain may be fused to the C-terminal portion of a second domain of a gene modifying polypeptide described herein for the joining of the N-terminal portion to the C-terminal portion, thereby joining the first and second domains. In some embodiments, the first and second domains are each independently chosen from a DNA binding domain, an RNA binding domain, an RT domain, and an endonuclease domain.

Inteins can occur as self-splicing protein intron (e.g., peptide), e.g., which ligates flanking N-terminal and C-terminal exteins (e.g., fragments to be joined). An intein may, in some instances, comprise a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing."

In some embodiments, an intein of a precursor protein (an intein containing protein prior to intein-mediated protein splicing) comes from two genes. Such intein is referred to herein as a split intein (e.g., split intein-N and split intein-C). Accordingly, an intein-based approach may be used to join a first polypeptide sequence and a second polypeptide sequence together. For example, in cyanobacteria, DnaE, the catalytic subunit a of DNA polymerase III, is encoded by two separate genes, dnaE-n and dnaE-c. An intein-N domain, such as that encoded by the dnaE-n gene, when situated as part of a first polypeptide sequence, may join the first polypeptide sequence with a second polypeptide sequence, wherein the second polypeptide sequence comprises an intein-C domain, such as that encoded by the dnaE-c gene. Accordingly, in some embodiments, a protein can be made by providing nucleic acid encoding the first and second polypeptide sequences (e.g., wherein a first nucleic acid molecule encodes the first polypeptide sequence and a second nucleic acid molecule encodes the second polypeptide sequence), and the nucleic acid is introduced into the cell under conditions that allow for production of the first and second polypeptide sequences, and for joining of the first to the second polypeptide sequence via an intein-based mechanism.

Use of inteins for joining heterologous protein fragments is described, for example, in Wood et al., J. Biol. Chem. 289(21); 14512-9 (2014) (incorporated herein by reference in its entirety). For example, when fused to separate protein fragments, the inteins IntN and IntC may recognize each other, splice themselves out, and/or simultaneously ligate the flanking N- and C-terminal exteins of the protein fragments to which they were fused, thereby reconstituting a full-length protein from the two protein fragments.

In some embodiments, a synthetic intein based on the dnaE intein, the Cfa-N (e.g., split intein-N) and Cfa-C (e.g., split intein-C) intein pair, is used. Examples of such inteins have been described, e.g., in Stevens et al., J Am Chem Soc. 2016 Feb. 24; 138(7):2162-5 (incorporated herein by reference in its entirety). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394, 604, incorporated herein by reference).

In some embodiments involving a split Cas9, an intein-N domain and an intein-C domain may be fused to the N-terminal portion of the split Cas9 and the C-terminal portion of a split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N [N-terminal portion of the split Cas9]-[intein-N]~ C. In some embodiments, an intein-C is fused to the N-terminus of the C-terminal portion of the split Cas9, i.e., to form a structure of N-[intein-C]~ [C-terminal portion of the split Cas9]-C. The mechanism of intein-mediated protein splicing for joining the proteins the inteins are fused to (e.g., split Cas9) is described in Shah et al., Chem Sci. 2014; 5(1):446-461, incorporated herein by reference. Methods for designing and using inteins are known in the art and described, for example by WO2020051561, WO2014004336, WO2017132580, US20150344549, and US20180127780, each of which is incorporated herein by reference in their entirety.

In some embodiments, a split refers to a division into two or more fragments. In some embodiments, a split Cas9 protein or split Cas9 comprises a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a reconstituted Cas9 protein. In embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871 and PDB file: 5F9R (each of which is incorporated herein by reference in its entirety). A disordered region may be determined by one or more protein structure determination techniques known in the art, including, without limitation, X-ray crystallography, NMR spectroscopy, electron microscopy (e.g., cryoEM), and/or in silico protein modeling. In some embodiments, the protein is divided into two fragments at any C, T, A, or S, e.g., within a region of SpCas9 between amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9

T310, T313, A456, S469, or C574. In some embodiments, the process of dividing the protein into two fragments is referred to as splitting the protein.

In some embodiments, a protein fragment ranges from about 2-1000 amino acids (e.g., between 2-10, 10-50, 50-100, 100-200, 200-300, 300-400, 400-500, 500-600, 600-700, 700-800, 800-900, or 900-1000 amino acids) in length. In some embodiments, a protein fragment ranges from about 5-500 amino acids (e.g., between 5-10, 10-50, 50-100, 100-200, 200-300, 300-400, or 400-500 amino acids) in length. In some embodiments, a protein fragment ranges from about 20-200 amino acids (e.g., between 20-30, 30-40, 40-50, 50-100, or 100-200 amino acids) in length.

In some embodiments, a portion or fragment of a gene modifying polypeptide is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In some embodiments, an endonuclease domain (e.g., a nickase Cas9 domain) is fused to intein-N and a polypeptide comprising an RT domain is fused to an intein-C.

Exemplary nucleotide and amino acid sequences of intein-N domains and compatible intein-C domains are provided below:

DnaE Intein-N DNA:
(SEQ ID NO: 5029)
TGCCTGTCATACGAAACCGAGATACTGACAGTAGAATATGGCCTTCTGC

CAATCGGGAAGATTGTGGAGAAACGGATAGAATGCACAGTTTACTCTGT

CGATAACAATGGTAACATTTATACTCAGCCAGTTGCCCAGTGGCACGAC

CGGGGAGAGCAGGAAGTATTCGAATACTGTCTGGAGGATGGAAGTCTCA

TTAGGGCCACTAAGGACCACAAATTTATGACAGTCGATGGCCAGATGCT

GCCTATAGACGAAATCTTTGAGCGAGAGTTGGACCTCATGCGAGTTGAC

AACCTTCCTAAT

DnaE Intein-N Protein:
(SEQ ID NO: 5030)
CLSYETEILTVEYGLLPIGKIVEKRIECTVYSVDNNGNIYTQPVAQWHD

RGEQEVFEYCLEDGSLIRATKDHKFMTVDGQMLPIDEIFERELDLMRVD

NLPN

DnaE Intein-C DNA:
(SEQ ID NO: 5031)
ATGATCAAGATAGCTACAAGGAAGTATCTTGGCAAACAAAACGTTTATG

ATATTGGAGTCGAAAGAGATCACAACTTTGCTCTGAAGAACGGATTCAT

AGCTTCTAAT

DnaE Intein-C Protein:
(SEQ ID NO: 5032)
MIKIATRKYLGKQNVYDIGVERDHNFALKNGFIASN

Cfa-N DNA:
(SEQ ID NO: 5033)
TGCCTGTCTTATGATACCGAGATACTTACCGTTGAATATGGCTTCTGC

CTATTGGAAAGATTGTCGAAGAGAGAATTGAATGCACAGTATATACTGT

AGACAAGAATGGTTTCGTTTACACACAGCCCATTGCTCAATGGCACAAT

CGCGGCGAACAAGAAGTATTTGAGTACTGTCTCGAGGATGGAAGCATCA

TACGAGCAACTAAAGATCATAAATTCATGACCACTGACGGGCAGATGTT

GCCAATAGATGAGATATTCGAGCGGGGCTTGGATCTCAAACAAGTGGAT

GGATTG CCA

Cfa-N Protein:
(SEQ ID NO: 5034)
CLSYDTEILTVEYGFLPIGKIVEERIECTVYTVDKNGFVYTQPIAQWHN

RGEQEVFEYCLEDGSIIRATKDHKFMTTDGQMLPIDEIFERGLDLKQVD

GLP

Cfa-C DNA:
(SEQ ID NO: 5035)
ATGAAGAGGACTGCCGATGGATCAGAGTTTGAATCTCCCAAGAAGAAGA

GGAAAGTAAAGATAATATCTCGAAAAAGTCTTGGTACCCAAAATGTCTA

TGATATTGGAGTGGAGAAAGATCACAACTTCCTTCTCAAGAACGGTCTC

GTAGCCAGCAAC

Cfa-C Protein:
(SEQ ID NO: 5036)
MKRTADGSEFESPKKKRKVKIISRKSLGTQNVYDIGVEKDHNFLLKNGL

VASN

Additional Domains

The gene modifying polypeptide can bind a target DNA sequence and template nucleic acid (e.g., template RNA), nick the target site, and write (e.g., reverse transcribe) the template into DNA, resulting in a modification of the target site. In some embodiments, additional domains may be added to the polypeptide to enhance the efficiency of the process. In some embodiments, the gene modifying polypeptide may contain an additional DNA ligation domain to join reverse transcribed DNA to the DNA of the target site. In some embodiments, the polypeptide may comprise a heterologous RNA-binding domain. In some embodiments, the polypeptide may comprise a domain having 5' to 3' exonuclease activity (e.g., wherein the 5' to 3' exonuclease activity increases repair of the alteration of the target site, e.g., in favor of alteration over the original genomic sequence). In some embodiments, the polypeptide may comprise a domain having 3' to 5' exonuclease activity, e.g., proof-reading activity. In some embodiments, the writing domain, e.g., RT domain, has 3' to 5' exonuclease activity, e.g., proof-reading activity.

Template Nucleic Acids

The gene modifying systems described herein can modify a host target DNA site using a template nucleic acid sequence. In some embodiments, the gene modifying systems described herein transcribe an RNA sequence template into host target DNA sites by target-primed reverse transcription (TPRT). By modifying DNA sequence(s) via reverse transcription of the RNA sequence template directly into the host genome, the gene modifying system can insert an object sequence into a target genome without the need for exogenous DNA sequences to be introduced into the host cell (unlike, for example, CRISPR systems), as well as eliminate an exogenous DNA insertion step. The gene modifying system can also delete a sequence from the target genome or introduce a substitution using an object sequence. Therefore, the gene modifying system provides a platform for the use of customized RNA sequence templates containing object sequences, e.g., sequences comprising heterologous gene coding and/or function information.

In some embodiments, the template nucleic acid comprises one or more sequence (e.g., 2 sequences) that binds the gene modifying polypeptide.

In some embodiments a system or method described herein comprises a single template nucleic acid (e.g., template RNA). In some embodiments a system or method described herein comprises a plurality of template nucleic acids (e.g., template RNAs). For example, a system described herein comprises a first RNA comprising (e.g., from 5' to 3') a sequence that binds the gene modifying polypeptide (e.g., the DNA-binding domain and/or the endonuclease domain, e.g., a gRNA) and a sequence that binds a target site (e.g., a second strand of a site in a target genome), and a second RNA (e.g., a template RNA) comprising (e.g., from 5' to 3') optionally a sequence that binds the gene modifying polypeptide (e.g., that specifically binds the RT domain), a heterologous object sequence, and a PBS sequence. In some embodiments, when the system comprises a plurality of nucleic acids, each nucleic acid comprises a conjugating domain. In some embodiments, a conjugating domain enables association of nucleic acid molecules, e.g., by hybridization of complementary sequences. For example, in some embodiments a first RNA comprises a first conjugating domain and a second RNA comprises a second conjugating domain, and the first and second conjugating domains are capable of hybridizing to one another, e.g., under stringent conditions. In some embodiments, the stringent conditions for hybridization include hybridization in 4× sodium chloride/sodium citrate (SSC), at about 65 C, followed by a wash in 1×SSC, at about 65 C.

In some embodiments, the template nucleic acid comprises RNA. In some embodiments, the template nucleic acid comprises DNA (e.g., single stranded or double stranded DNA).

In some embodiments, the template nucleic acid comprises one or more (e.g., 2) homology domains that have homology to the target sequence. In some embodiments, the homology domains are about 10-20, 20-50, or 50-100 nucleotides in length.

In some embodiments, a template RNA can comprise a gRNA sequence, e.g., to direct the gene modifying polypeptide to a target site of interest. In some embodiments, a template RNA comprises (e.g., from 5' to 3') (i) optionally a gRNA spacer that binds a target site (e.g., a second strand of a site in a target genome), (ii) optionally a gRNA scaffold that binds a polypeptide described herein (e.g., a gene modifying polypeptide or a Cas polypeptide), (iii) a heterologous object sequence comprising a mutation region (optionally the heterologous object sequence comprises, from 5' to 3', a first homology region, a mutation region, and a second homology region), and (iv) a primer binding site (PBS) sequence comprising a 3' target homology domain.

The template nucleic acid (e.g., template RNA) component of a genome editing system described herein typically is able to bind the gene modifying polypeptide of the system. In some embodiments the template nucleic acid (e.g., template RNA) has a 3' region that is capable of binding a gene modifying polypeptide. The binding region, e.g., 3' region, may be a structured RNA region, e.g., having at least 1, 2 or 3 hairpin loops, capable of binding the gene modifying polypeptide of the system. The binding region may associate the template nucleic acid (e.g., template RNA) with any of the polypeptide modules. In some embodiments, the binding region of the template nucleic acid (e.g., template RNA) may associate with an RNA-binding domain in the polypeptide. In some embodiments, the binding region of the template nucleic acid (e.g., template RNA) may associate with the reverse transcription domain of the gene modifying polypeptide (e.g., specifically bind to the RT domain). In some embodiments, the template nucleic acid (e.g., template RNA) may associate with the DNA binding domain of the polypeptide, e.g., a gRNA associating with a Cas9-derived DNA binding domain. In some embodiments, the binding region may also provide DNA target recognition, e.g., a gRNA hybridizing to the target DNA sequence and binding the polypeptide, e.g., a Cas9 domain. In some embodiments, the template nucleic acid (e.g., template RNA) may associate with multiple components of the polypeptide, e.g., DNA binding domain and reverse transcription domain.

In some embodiments the template RNA has a poly-A tail at the 3' end. In some embodiments the template RNA does not have a poly-A tail at the 3' end.

In some embodiments, a template RNA may be customized to correct a given mutation in the genomic DNA of a target cell (e.g., ex vivo or in vivo, e.g., in a target tissue or organ, e.g., in a subject). For example, the mutation may be a disease-associated mutation relative to the wild-type sequence. Without wishing to be bound by theory, any given target site and edit will have a large number of possible template RNA molecules for use in a gene modifying system that will result in a range of editing efficiencies and fidelities. To partially reduce this screening burden, sets of empirical parameters help ensure optimal initial in silico designs of template RNAs or portions thereof. As a non-limiting illustrative example, for a selected mutation, the following design parameters may be employed. In some embodiments, design is initiated by acquiring approximately 500 bp (e.g., up to 50, 100, 150, 200, 250, 300, 350, 400, 450, 500, 550, 600, 650, or 700 bp, and optionally at least 20, 30, 40, 50, 100, 150, 200, 250, 300, 350, 400, 450, 500, 550, 600, or 650 bp) flanking sequence on either side of the mutation to serve as the target region. In some embodiments, a template nucleic acid comprises a gRNA. In some embodiments, a gRNA comprises a sequence (e.g., a CRISPR spacer) that binds a target site. In some embodiments, the sequence (e.g., a CRISPR spacer) that binds a target site for use in targeting a template nucleic acid to a target region is selected by considering the particular gene modifying polypeptide (e.g., endonuclease domain or writing domain, e.g., comprising a CRISPR/Cas domain) being used (e.g., for Cas9, a protospacer-adjacent motif (PAM) of NGG immediately 3' of a 20 nucleotide gRNA binding region). In some embodiments, the CRISPR spacer is selected by ranking first by whether the PAM will be disrupted by the gene modifying system induced edit. In some embodiments, disruption of the PAM may increase edit efficiency. In some embodiments, the PAM can be disrupted by also introducing (e.g., as part of or in addition to another modification to a target site in genomic DNA) a silent mutation (e.g., a mutation that does not alter an amino acid residue encoded by the target nucleic acid sequence, if any) in the target site during gene modification. In some embodiments, the CRISPR spacer is selected by ranking sequences by the proximity of their corresponding genomic site to the desired edit location. In some embodiments, the gRNA comprises a gRNA scaffold. In some embodiments, the gRNA scaffold used may be a standard scaffold (e.g., for Cas9, 5'-GTTTTAGAGCTAGAAATAGCAAGT-TAAAATAAGGCTAGTCCGTTATCAACTT-GAAAAAGTGG CACCGAGTCGGTGC-3'; SEQ ID NO: 11,003), or may contain one or more nucleotide substitutions. In some embodiments, the heterologous object sequence has at least 90% identity, e.g., at least 90%, 95%, 98%, 99%, or 100% identity, or comprises no more than 1, 2, 3, 4, or 5 positions of non-identity to the target site 3' of the first strand nick (e.g., immediately 3' of the first strand nick or up to 1, 2, 3, 4, or 5 nucleotides 3' of the first strand nick), with the exception of any insertion, substitution, or deletion that may be written into the target site by the gene modifying. In some embodiments, the 3' target homology domain contains at least 90% identity, e.g., at least 90%, 95%, 98%, 99%, or 100% identity, or comprises no more than 1, 2, 3, 4, or 5 positions of non-identity to the target site 5' of the first strand nick (e.g., immediately 5' of the first strand nick or up to 1, 2, 3, 4, or 5 nucleotides 3' of the first strand nick).

In some embodiments, the template nucleic acid is a template RNA. In some embodiments, the template RNA comprises one or more modified nucleotides. For example, in some embodiments, the template RNA comprises one or more deoxyribonucleotides. In some embodiments, regions of the template RNA are replaced by DNA nucleotides, e.g., to enhance stability of the molecule. For example, the 3' end of the template may comprise DNA nucleotides, while the rest of the template comprises RNA nucleotides that can be reverse transcribed. For instance, in some embodiments, the heterologous object sequence is primarily or wholly made up of RNA nucleotides (e.g., at least 90%, 95%, 98%, or 99% RNA nucleotides). In some embodiments, the PBS sequence is primarily or wholly made up of DNA nucleotides (e.g., at least 90%, 95%, 98%, or 99% DNA nucleotides). In other embodiments, the heterologous object sequence for writing into the genome may comprise DNA nucleotides. In some embodiments, the DNA nucleotides in the template are copied into the genome by a domain capable of DNA-dependent DNA polymerase activity. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second strand synthesis. In some embodiments, the template molecule is composed of only DNA nucleotides.

In some embodiments, a system described herein comprises two nucleic acids which together comprise the sequences of a template RNA described herein. In some embodiments, the two nucleic acids are associated with each other non-covalently, e.g., directly associated with each other (e.g., via base pairing), or indirectly associated as part of a complex comprising one or more additional molecule.

A template RNA described herein may comprise, from 5' to 3': (1) a gRNA spacer; (2) a gRNA scaffold; (3) heterologous object sequence (4) a primer binding site (PBS) sequence. Each of these components is now described in more detail.

gRNA Spacer and gRNA Scaffold

A template RNA described herein may comprise a gRNA spacer that directs the gene modifying system to a target nucleic acid, and a gRNA scaffold that promotes association of the template RNA with the Cas domain of the gene modifying polypeptide. The systems described herein can also comprise a gRNA that is not part of a template nucleic acid. For example, a gRNA that comprises a gRNA spacer and gRNA scaffold, but not a heterologous object sequence or a PBS sequence, can be used, e.g., to induce second strand nicking, e.g., as described in the section herein entitled "Second Strand Nicking".

In some embodiments, the gRNA is a short synthetic RNA composed of a scaffold sequence that participates in CRISPR-associated protein binding and a user-defined ~20 nucleotide targeting sequence for a genomic target. The structure of a complete gRNA was described by Nishimasu et al. Cell 156, P935-949 (2014). The gRNA (also referred to as sgRNA for single-guide RNA) consists of crRNA- and tracrRNA-derived sequences connected by an artificial tetraloop. The crRNA sequence can be divided into guide (20 nt) and repeat (12 nt) regions, whereas the tracrRNA sequence can be divided into anti-repeat (14 nt) and three tracrRNA stem loops (Nishimasu et al. Cell 156, P935-949 (2014)). In practice, guide RNA sequences are generally designed to have a length of between 17-24 nucleotides (e.g., 19, 20, or 21 nucleotides) and be complementary to a targeted nucleic acid sequence. Custom gRNA generators and algorithms are available commercially for use in the design of effective guide RNAs. In some embodiments, the gRNA comprises two RNA components from the native CRISPR system, e.g. crRNA and tracrRNA. As is well known in the art, the gRNA may also comprise a chimeric, single guide RNA (sgRNA) containing sequence from both a tracrRNA (for binding the nuclease) and at least one crRNA (to guide the nuclease to the sequence targeted for editing/binding). Chemically modified sgRNAs have also been demonstrated to be effective for use with CRISPR-associated proteins; see, for example, Hendel et al. (2015) Nature Biotechnol., 985-991. In some embodiments, a gRNA spacer comprises a nucleic acid sequence that is complementary to a DNA sequence associated with a target gene.

In some embodiments, the region of the template nucleic acid, e.g., template RNA, comprising the gRNA adopts an underwound ribbon-like structure of gRNA bound to target DNA (e.g., as described in Mulepati et al. Science 19 Sep. 2014:Vol. 345, Issue 6203, pp. 1479-1484). Without wishing to be bound by theory, this non-canonical structure is thought to be facilitated by rotation of every sixth nucleotide out of the RNA-DNA hybrid. Thus, in some embodiments, the region of the template nucleic acid, e.g., template RNA, comprising the gRNA may tolerate increased mismatching with the target site at some interval, e.g., every sixth base. In some embodiments, the region of the template nucleic acid, e.g., template RNA, comprising the gRNA comprising homology to the target site may possess wobble positions at a regular interval, e.g., every sixth base, that do not need to base pair with the target site.

In some embodiments, the template nucleic acid (e.g., template RNA) has at least 15, 16, 17, 18, 19, 20, 21, 22, 23, or 24 bases of at least 80%, 85%, 90%, 95%, 99%, or 100% homology to the target site, e.g., at the 5' end, e.g., comprising a gRNA spacer sequence of length appropriate to the Cas9 domain of the gene modifying polypeptide (Table 8).

Table 12 provides parameters to define components for designing gRNA and/or Template RNAs to apply Cas variants listed in Table 8 for gene modifying. The cut site indicates the validated or predicted protospacer adjacent motif (PAM) requirements, validated or predicted location of cut site (relative to the most upstream base of the PAM site). The gRNA for a given enzyme can be assembled by concatenating the crRNA, Tetraloop, and tracrRNA sequences, and further adding a 5' spacer of a length within Spacer (min) and Spacer (max) that matches a protospacer at a target site. Further, the predicted location of the ssDNA nick at the target is important for designing a PBS sequence of a Template RNA that can anneal to the sequence immediately 5' of the nick in order to initiate target primed reverse transcription. In some embodiments, a gRNA scaffold described herein comprises a nucleic acid sequence comprising, in the 5' to 3' direction, a crRNA of Table 12, a tetraloop from the same row of Table 12, and a tracrRNA from the same row of Table 12, or a sequence having at least 70%, 80%, 85%, 90%, 95%, or 99% identity thereto. In some embodiments, the gRNA or template RNA comprising the scaffold further comprises a gRNA spacer having a length within the Spacer (min) and Spacer (max) indicated in the same row of Table 12. In some embodiments, the gRNA or template RNA having a sequence according to Table 12 is comprised by a system that further comprises a gene modifying polypeptide, wherein the gene modifying polypeptide comprises a Cas domain described in the same row of Table 12.

TABLE 12

Parameters to define components for designing gRNA and/or Template RNAs to apply Cas variants listed in Table 8 in gene modifying systems

| Variant | PAM(s) | Cut | Tier | Spacer (min) | Spacer (max) | crRNA | SEQ ID NO: | Tetraloop | tracrRNA | SEQ ID NO: |
|---|---|---|---|---|---|---|---|---|---|---|
| Nme2Cas9 | NNNNCC | -3 | 1 | 22 | 24 | GTTGTAGCTCCCTTTCTCATTTCG | 10,051 | GAAA | CGAAATGAGAACCGTTGCTACAATAAGGCCGTCTGAAAAGATGTGCCGCAACGCTCTGCCCCTTAAAGCTTCTGCTTTAAGGGGCATCGTTTA | 10,151 |
| PpnCas9 | NNNNRTT | | 1 | 21 | 24 | GTTGTAGCTCCCTTTTTCATTTCGC | 10,052 | GAAA | GCGAAATGAAAAACGTTGTTACAATAAGAGATGAATTTCTCGCAAAGCTCTGCCTCTTGAAATTTCGGTTTCAAGAGGCATC | 10,152 |
| SauCas9 | NNGRR; NNGRRT | -3 | 1 | 21 | 23 | GTTTTAGTACTCTG | 10,053 | GAAA | CAGAATCTACTAAAACAAGGCAAAATGCCGTGTTTATCTCGTCAACTTGTTGGCGAGA | 10,153 |
| SauCas9-KKH | NNNRR; NNNRRT | -3 | 1 | 21 | 21 | GTTTTAGTACTCTG | 10,054 | GAAA | CAGAATCTACTAAAACAAGGCAAAATGCCGTGTTTATCTCGTCAACTTGTTGGCGAGA | 10,154 |
| SauriCas9 | NNGG | -3 | 1 | 21 | 21 | GTTTTAGTACTCTG | 10,055 | GAAA | CAGAATCTACTAAAACAAGGCAAAATGCCGTGTTTATCTCGTCAACTTGTTGGCGAGA | 10,155 |
| SauriCas9-KKH | NNRG | -3 | 1 | 21 | 21 | GTTTTAGTACTCTG | 10,056 | GAAA | CAGAATCTACTAAAACAAGGCAAAATGCCGTGTTTATCTCGTCAACTTGTTGGCGAGA | 10,156 |
| ScaCas9-Sc++ | NNG | -3 | 1 | 20 | 20 | GTTTTAGAGCTA | 10,057 | GAAA | TAGCAAGTTAAAATAAGGCTAGTCCGTTATCAACTTGAAAAGTGGCACCGAGTCGGTGC | 10,157 |
| SpyCas9 | NGG | -3 | 1 | 20 | 20 | GTTTTAGAGCTA | 10,058 | GAAA | TAGCAAGTTAAAATAAGGCTAGTCCGTTATCAACTTGAAAAGTGGCACCGAGTCGGTGC | 10,158 |
| SpyCas9_i_v1 | NGG | -3 | 1 | 20 | 20 | GTTTTAGAGCTA | 10057 | GAAA | TAGCAAGTTAAAATAAGGCTAGTCCGTTATCAACTTGGACTTCGGTCCAAGTGGCACCGAGTCGGTGC | 10,193 |
| SpyCas9_i_v2 | NGG | -3 | 1 | 20 | 20 | GTTTTAGAGCTA | 10057 | GAAA | TAGCAAGTTAAAATAAGGCTAGTCCGTTATCAACTTGGAGCTTGCTCCAAGTGGCACCGAGTCGGTGC | 10,194 |
| SpyCas9_i_v3 | NGG | -3 | 1 | 20 | 20 | GTTTTAGAGCTA | 10057 | GAAA | GTTTTAGAGCTAGAAATAGCAAGTTAAAATAAGGCTAGTCCGTTA | 10,195 |

TABLE 12-continued

Parameters to define components for designing gRNA and/or Template RNAs to apply Cas variants listed in Table 8 in gene modifying systems

| Variant | PAM(s) | Cut | Tier | Spacer (min) | Spacer (max) | crRNA | SEQ ID NO: | Tetraloop | tracrRNA | SEQ ID NO: |
|---|---|---|---|---|---|---|---|---|---|---|
| | | | | | | | | | TCGACTTGAAAAAGT CGCACCGAGTCGGTG C | |
| SpyCas9-NG | NG (NGG = NG A = NGT > N GC) | -3 | 1 | 20 | 20 | GTTTTAGA GCTA | 10,059 | GAAA | TAGCAAGTTAAAATA AGGCTAGTCCGTTAT CAACTTGAAAAAGTG GCACCGAGTCGGTGC | 10,159 |
| SpyCas9-SpRY | NRN > NYN | -3 | 1 | 20 | 20 | GTTTTAGA GCTA | 10,060 | GAAA | TAGCAAGTTAAAATA AGGCTAGTCCGTTAT CAACTTGAAAAAGTG GCACCGAGTCGGTGC | 10,160 |
| St1Cas9 | NNAGAA W > NNAG GAW = NN GGAAW | -3 | 1 | 20 | 20 | GTCTTTGTA CTCTG | 10,061 | GTAC | CAGAAGCTACAAAGA TAAGGCTTCATGCCG AAATCAACACCCTGT CATTTTATGGCAGGG TGTTTT | 10,161 |
| BlatCas9 | NNNNCN AA > NNNN CNDD > NN NNC | -3 | 1 | 19 | 23 | GCTATAGT TCCTTACT | 10,062 | GAAA | GGTAAGTTGCTATAG TAAGGGCAACAGACC CGAGGCGTTGGGGAT CGCCTAGCCCGTGTT TACGGGCTCTCCCCA TATTCAAAATAATGA CAGACGAGCACCTTG GAGCATTTATCTCCG AGGTGCT | 10,162 |
| cCas9-v16 | NNVACT; NNVATGM; NNVATT; NNVGCT; NNVGTG; NNVGTT | -3 | 2 | 21 | 21 | GTCTTAGT ACTCTG | 10,063 | GAAA | CAGAATCTACTAAGA CAAGGCAAAATGCCG TGTTTATCTCGTCAA CTTGTTGGCGAGA | 10,163 |
| cCas9-v17 | NNVRRN | -3 | 2 | 21 | 21 | GTCTTAGT ACTCTG | 10,064 | GAAA | CAGAATCTACTAAGA CAAGGCAAAATGCCG TGTTTATCTCGTCAA CTTGTTGGCGAGA | 10,164 |
| cCas9-v21 | NNVACT; NNVATGM; NNVATT; NNVGCT; NNVGTG; NNVGTT | -3 | 2 | 21 | 21 | GTCTTAGT ACTCTG | 10,065 | GAAA | CAGAATCTACTAAGA CAAGGCAAAATGCCG TGTTTATCTCGTCAA CTTGTTGGCGAGA | 10,165 |
| cCas9-v42 | NNVRRN | -3 | 2 | 21 | 21 | GTCTTAGT ACTCTG | 10,066 | GAAA | CAGAATCTACTAAGA CAAGGCAAAATGCCG TGTTTATCTCGTCAA CTTGTTGGCGAGA | 10,166 |
| CdiCas9 | NNRHHHY; NNRAAAY | | 2 | 22 | 22 | ACTGGGGT TCAG | 10,067 | GAAA | CTGAACCTCAGTAAG CATTGGCTCGTTTCC AATGTTGATTGCTCC GCCGGTGCTCCTTAT TITTAAGGGCGCCGG C | 10,167 |
| CjeCas9 | NNNNRYA C | -3 | 2 | 21 | 23 | GTTTTAGTC CCT | 10,068 | GAAA | AGGGACTAAAATAAA GAGTTTGCGGGACTC TGCGGGGTTACAATC CCCTAAAACCGC | 10,168 |
| GeoCas9 | NNNNCRA A | | 2 | 21 | 23 | GTCATAGT TCCCCTGA | 10,069 | GAAA | TCAGGGTTACTATGA TAAGGGCTTTCTGCC TAAGGCAGACTGACC CGCGGCGTTGGGGAT CGCCTGTCGCCCGCT TTTGGCGGGCATTCC CCATCCTT | 10,169 |

TABLE 12-continued

Parameters to define components for designing gRNA and/or
Template RNAs to apply Cas variants listed in Table 8
in gene modifying systems

| Variant | PAM(s) | Cut | Tier | Spacer (min) | Spacer (max) | crRNA | SEQ ID NO: | Tetraloop | tracrRNA | SEQ ID NO: |
|---|---|---|---|---|---|---|---|---|---|---|
| iSpyMacCas9 | NAAN | -3 | 2 | 19 | 21 | GTTTTAGA GCTA | 10,070 | GAAA | TAGCAAGTTAAAATA AGGCTAGTCCGTTAT CAACTTGAAAAAGTG GCACCGAGTCGGTGC | 10,170 |
| NmeCas9 | NNNNGA YT; NNNN GYTT; NN NNGAYA; NNNNGTC T | -3 | 2 | 20 | 24 | GTTGTAGC TCCCTTTCT CATTTCG | 10,071 | GAAA | CGAAATGAGAACCGT TGCTACAATAAGGCC GTCTGAAAAGATGTG CCGCAACGCTCTGCC CCTTAAAGCTTCTGC TTTAAGGGGCATCGT TTA | 10,171 |
| ScaCas9 | NNG | -3 | 2 | 20 | 20 | GTTTTAGA GCTA | 10,072 | GAAA | TAGCAAGTTAAAATA AGGCTAGTCCGTTAT CAACTTGAAAAAGTG GCACCGAGTCGGTGC | 10,172 |
| ScaCas9-HiFi-Sc++ | NNG | -3 | 2 | 20 | 20 | GTTTTAGA GCTA | 10,073 | GAAA | TAGCAAGTTAAAATA AGGCTAGTCCGTTAT CAACTTGAAAAAGTG GCACCGAGTCGGTGC | 10,173 |
| SpyCas9-3var-NRRH | NRRH | -3 | 2 | 20 | 20 | GTTTAAGA GCTATGCT G | 10,074 | GAAA | CAGCATAGCAAGTTT AAATAAGGCTAGTCC GTTATCAACTTGAAA AAGTGGCACCGAGTC GGTGC | 10,174 |
| SpyCas9-3var-NRTH | NRTH | -3 | 2 | 20 | 20 | GTTTAAGA GCTATGCT G | 10,075 | GAAA | CAGCATAGCAAGTTT AAATAAGGCTAGTCC GTTATCAACTTGAAA AAGTGGCACCGAGTC GGTGC | 10,175 |
| SpyCas9-3var-NRCH | NRCH | -3 | 2 | 20 | 20 | GTTTAAGA GCTATGCT G | 10,076 | GAAA | CAGCATAGCAAGTTT AAATAAGGCTAGTCC GTTATCAACTTGAAA AAGTGGCACCGAGTC GGTGC | 10,176 |
| SpyCas9-HF1 | NGG | -3 | 2 | 20 | 20 | GTTTTAGA GCTA | 10,077 | GAAA | TAGCAAGTTAAAATA AGGCTAGTCCGTTAT CAACTTGAAAAAGTG GCACCGAGTCGGTGC | 10,177 |
| SpyCas9-QQR1 | NAAG | -3 | 2 | 20 | 20 | GTTTTAGA GCTA | 10,078 | GAAA | TAGCAAGTTAAAATA AGGCTAGTCCGTTAT CAACTTGAAAAAGTG GCACCGAGTCGGTGC | 10,178 |
| SpyCas9-SpG | NGN | -3 | 2 | 20 | 20 | GTTTTAGA GCTA | 10,079 | GAAA | TAGCAAGTTAAAATA AGGCTAGTCCGTTAT CAACTTGAAAAAGTG GCACCGAGTCGGTGC | 10,179 |
| SpyCas9-VQR | NGAN | -3 | 2 | 20 | 20 | GTTTTAGA GCTA | 10,080 | GAAA | TAGCAAGTTAAAATA AGGCTAGTCCGTTAT CAACTTGAAAAAGTG GCACCGAGTCGGTGC | 10,180 |
| SpyCas9-VRER | NGCG | -3 | 2 | 20 | 20 | GTTTTAGA GCTA | 10,081 | GAAA | TAGCAAGTTAAAATA AGGCTAGTCCGTTAT CAACTTGAAAAAGTG GCACCGAGTCGGTGC | 10,181 |
| SpyCas9-xCas | NG; GAA; GAT | -3 | 2 | 20 | 20 | GTTTAAGA GCTATGCT G | 10,082 | GAAA | CAGCATAGCAAGTTT AAATAAGGCTAGTCC GTTATCAACTTGAAA AAGTGGCACCGAGTC GGTGC | 10,182 |

TABLE 12-continued

Parameters to define components for designing gRNA and/or Template RNAs to apply Cas variants listed in Table 8 in gene modifying systems

| Variant | PAM(s) | Cut | Tier | Spacer (min) | Spacer (max) | crRNA | SEQ ID NO: | Tetraloop | tracrRNA | SEQ ID NO: |
|---|---|---|---|---|---|---|---|---|---|---|
| SpyCas9-xCas-NG | NG | -3 | 2 | 20 | 20 | GTTTAAGAGCTATGCTG | 10,083 | GAAA | CAGCATAGCAAGTTTAAATAAGGCTAGTCCGTTATCAACTTGAAAAAGTGGCACCGAGTCGGTGC | 10,183 |
| St1Cas9-CNRZ1066 | NNACAA | -3 | 2 | 20 | 20 | GTCTTTGTACTCTG | 10,084 | GTAC | CAGAAGCTACAAAGATAAGGCTTCATGCCGAAATCAACACCCTGTCATTTTATGGCAGGGTGTTTT | 10,184 |
| St1Cas9-LMG1831 | NNGCAA | -3 | 2 | 20 | 20 | GTCTTTGTACTCTG | 10,085 | GTAC | CAGAAGCTACAAAGATAAGGCTTCATGCCGAAATCAACACCCTGTCATTTTATGGCAGGGTGTTTT | 10,185 |
| St1Cas9-MTH17CL396 | NNAAAA | -3 | 2 | 20 | 20 | GTCTTTGTACTCTG | 10,086 | GTAC | CAGAAGCTACAAAGATAAGGCTTCATGCCGAAATCAACACCCTGTCATTTTATGGCAGGGTGTTTT | 10,186 |
| St1Cas9-TH1477 | NNGAAA | -3 | 2 | 20 | 20 | GTCTTTGTACTCTG | 10,087 | GTAC | CAGAAGCTACAAAGATAAGGCTTCATGCCGAAATCAACACCCTGTCATTTTATGGCAGGGTGTTTT | 10,187 |
| SRGN3.1 | NNGG | | 1 | 21 | 23 | GTTTTAGTACTCTG | 10,088 | GAAA | CAGAATCTACTGAAACAAGACAATATGTCGTGTTTATCCCATCAATTTATTGGTGGGATTTT | 10,188 |
| SRGN3.3 | NNGG | | 1 | 21 | 23 | GTTTTAGTACTCTG | 10,089 | GAAA | CAGAATCTACTGAAACAAGACAATATGTCGTGTTTATCCCATCAATTTATTGGTGGGATTTT | 10,189 |

Herein, when an RNA sequence (e.g., a template RNA sequence) is said to comprise a particular sequence (e.g., a sequence of Table 12 or a portion thereof) that comprises thymine (T), it is of course understood that the RNA sequence may (and frequently does) comprise uracil (U) in place of T. For instance, the RNA sequence may comprise U at every position shown as T in the sequence in Table 12. More specifically, the present disclosure provides an RNA sequence according to every gRNA scaffold sequence of Table 12, wherein the RNA sequence has a U in place of each T in the sequence in Table 12. Additionally, it is understood that terminal Us and Ts may optionally be added or removed from tracrRNA sequences and may be modified or unmodified when provided as RNA. Without wishing to be bound by example, versions of gRNA scaffold sequences alternative to those exemplified in Table 12 may also function with the different Cas9 enzymes or derivatives thereof exemplified in Table 8, e.g., alternate gRNA scaffold sequences with nucleotide additions, substitutions, or deletions, e.g., sequences with stem-loop structures added or removed. It is contemplated herein that the gRNA scaffold sequences represent a component of gene modifying systems that can be similarly optimized for a given system, Cas-RT fusion polypeptide, indication, target mutation, template RNA, or delivery vehicle.

Heterologous Object Sequence

A template RNA described herein may comprise a heterologous object sequence that the gene modifying polypeptide can use as a template for reverse transcription, to write a desired sequence into the target nucleic acid. In some embodiments, the heterologous object sequence comprises, from 5' to 3', a post-edit homology region, the mutation region, and a pre-edit homology region. Without wishing to be bound by theory, an RT performing reverse transcription on the template RNA first reverse transcribes the pre-edit homology region, then the mutation region, and then the post-edit homology region, thereby creating a DNA strand comprising the desired mutation with a homology region on either side.

In some embodiments, the heterologous object sequence is at least 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nucleotides (nts) in length, or at least 1, 1.5, 2, 2.5, 3, 3.5, 4, 4.5, 5, 5.5, 6, 6.5, 7, 7.5, 8, 8.5, 9, 9.5, or 10 kilobases in length. In some embodiments, the heterologous object sequence is no more than 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, 1,000, or 2000 nucleotides (nts) in length, or no more than 20, 15, 10, 9, 8, 7, 6, 5, 4, or 3 kilobases in length. In some embodiments, the heterologous object sequence is 30-1000, 40-1000, 50-1000, 60-1000, 70-1000, 74-1000, 75-1000, 76-1000, 77-1000, 78-1000, 79-1000, 80-1000, 85-1000, 90-1000, 100-1000, 120-1000, 140-1000, 160-1000, 180-1000, 200-1000, 500-1000, 30-500, 40-500, 50-500, 60-500, 70-500, 74-500, 75-500, 76-500, 77-500, 78-500, 79-500, 80-500, 85-500, 90-500, 100-500, 120-500, 140-500, 160-500, 180-500, 200-500, 30-200, 40-200, 50-200, 60-200, 70-200, 74-200, 75-200, 76-200, 77-200, 78-200, 79-200, 80-200, 85-200, 90-200, 100-200, 120-200, 140-200, 160-200, 180-200, 30-100, 40-100, 50-100, 60-100, 70-100, 74-100, 75-100, 76-100, 77-100, 78-100, 79-100, 80-100, 85-100, or 90-100 nucleotides (nts) in length, or 1-20, 1-15, 1-10, 1-9, 1-8, 1-7, 1-6, 1-5, 1-4, 1-3, 1-2, 2-20, 2-15, 2-10, 2-9, 2-8, 2-7, 2-6, 2-5, 2-4, 2-3, 3-20, 3-15, 3-10, 3-9, 3-8, 3-7, 3-6, 3-5, 3-4, 4-20, 4-15, 4-10, 4-9, 4-8, 4-7, 4-6, 4-5, 5-20, 5-15, 5-10, 5-9, 5-8, 5-7, 5-6, 6-20, 6-15, 6-10, 6-9, 6-8, 6-7, 7-20, 7-15, 7-10, 7-9, 7-8, 8-20, 8-15, 8-10, 8-9, 9-20, 9-15, 9-10, 10-15, 10-20, or 15-20 kilobases in length. In some embodiments, the heterologous object sequence is 10-100, 10-90, 10-80, 10-70, 10-60, 10-50, 10-40, 10-30, or 10-20 nt in length, e.g., 10-80, 10-50, or 10-20 nt in length, e.g., about 10-20 nt in length. In some embodiments, the heterologous object sequence is 8-30, 9-25, 10-20, 11-16, or 12-15 nucleotides in length, e.g., is 11-16 nt in length. Without wishing to be bound by theory, in some embodiments, a larger insertion size, larger region of editing (e.g., the distance between a first edit/substitution and a second edit/substitution in the target region), and/or greater number of desired edits (e.g., mismatches of the heterologous object sequence to the target genome), may result in a longer optimal heterologous object sequence.

In certain embodiments, the template nucleic acid comprises a customized RNA sequence template which can be identified, designed, engineered and constructed to contain sequences altering or specifying host genome function, for example by introducing a heterologous coding region into a genome; affecting or causing exon structure/alternative splicing, e.g., leading to exon skipping of one or more exons; causing disruption of an endogenous gene, e.g., creating a genetic knockout; causing transcriptional activation of an endogenous gene; causing epigenetic regulation of an endogenous DNA; causing up-regulation of one or more operably linked genes, e.g., leading to gene activation or overexpression; causing down-regulation of one or more operably linked genes, e.g., creating a genetic knock-down; etc. In certain embodiments, a customized RNA sequence template can be engineered to contain sequences coding for exons and/or transgenes, provide binding sites for transcription factor activators, repressors, enhancers, etc., and combinations thereof. In some embodiments, a customized template can be engineered to encode a nucleic acid or peptide tag to be expressed in an endogenous RNA transcript or endogenous protein operably linked to the target site. In other embodiments, the coding sequence can be further customized with splice donor sites, splice acceptor sites, or poly-A tails.

The template nucleic acid (e.g., template RNA) of the system typically comprises an object sequence (e.g., a heterologous object sequence) for writing a desired sequence into a target DNA. The object sequence may be coding or non-coding. The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous sequence, wherein the reverse transcription will result in insertion of the heterologous sequence into the target DNA. In other embodiments, the RNA template may be designed to introduce a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to introduce an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, writing of an object sequence into a target site results in the substitution of nucleotides, e.g., where the full length of the object sequence corresponds to a matching length of the target site with one or more mismatched bases. In some embodiments, a heterologous object sequence may be designed such that a combination of sequence alterations may occur, e.g., a simultaneous addition and deletion, addition and substitution, or deletion and substitution.

In some embodiments, the heterologous object sequence may contain an open reading frame or a fragment of an open reading frame. In some embodiments the heterologous object sequence has a Kozak sequence. In some embodiments the heterologous object sequence has an internal ribosome entry site. In some embodiments the heterologous object sequence has a self-cleaving peptide such as a T2A or P2A site. In some embodiments the heterologous object sequence has a start codon. In some embodiments the template RNA has a splice acceptor site. In some embodiments the template RNA has a splice donor site. Exemplary splice acceptor and splice donor sites are described in WO2016044416, incorporated herein by reference in its entirety. Exemplary splice acceptor site sequences are known to those of skill in the art. In some embodiments the template RNA has a microRNA binding site downstream of the stop codon. In some embodiments the template RNA has a polyA tail downstream of the stop codon of an open reading frame. In some embodiments the template RNA comprises one or more exons. In some embodiments the template RNA comprises one or more introns. In some embodiments the template RNA comprises a eukaryotic transcriptional terminator. In some embodiments the template RNA comprises an enhanced translation element or a translation enhancing element. In some embodiments the RNA comprises the human T-cell leukemia virus (HTLV-1) R region. In some embodiments the RNA comprises a posttranscriptional regulatory element that enhances nuclear export, such as that of Hepatitis B Virus (HPRE) or Woodchuck Hepatitis Virus (WPRE).

In some embodiments, the heterologous object sequence may contain a non-coding sequence. For example, the template nucleic acid (e.g., template RNA) may comprise a regulatory element, e.g., a promoter or enhancer sequence or miRNA binding site. In some embodiments, integration of the object sequence at a target site will result in upregulation of an endogenous gene. In some embodiments, integration of the object sequence at a target site will result in downregulation of an endogenous gene. In some embodiments the template nucleic acid (e.g., template RNA) comprises a tissue specific promoter or enhancer, each of which may be unidirectional or bidirectional. In some embodiments the promoter is an RNA polymerase I promoter, RNA polymerase II promoter, or RNA polymerase III promoter. In some embodiments the promoter comprises a TATA element. In some embodiments the promoter comprises a B recognition element. In some embodiments the promoter has one or more binding sites for transcription factors.

In some embodiments, the template nucleic acid (e.g., template RNA) comprises a site that coordinates epigenetic modification. In some embodiments, the template nucleic acid (e.g., template RNA) comprises a chromatin insulator. For example, the template nucleic acid (e.g., template RNA) comprises a CTCF site or a site targeted for DNA methylation.

In some embodiments, the template nucleic acid (e.g., template RNA) comprises a gene expression unit composed of at least one regulatory region operably linked to an effector sequence. The effector sequence may be a sequence that is transcribed into RNA (e.g., a coding sequence or a non-coding sequence such as a sequence encoding a micro RNA).

In some embodiments, the heterologous object sequence of the template nucleic acid (e.g., template RNA) is inserted into a target genome in an endogenous intron. In some embodiments, the heterologous object sequence of the template nucleic acid (e.g., template RNA) is inserted into a target genome and thereby acts as a new exon. In some embodiments, the insertion of the heterologous object sequence into the target genome results in replacement of a natural exon or the skipping of a natural exon.

In some embodiments, the heterologous object sequence of the template nucleic acid (e.g., template RNA) is inserted into the target genome in a genomic safe harbor site, such as AAVS1, CCR5, ROSA26, or albumin locus. In some embodiments, a gene modifying is used to integrate a CAR into the T-cell receptor α constant (TRAC) locus (Eyquem et al Nature 543, 113-117 (2017)). In some embodiments, a gene modifying system is used to integrate a CAR into a T-cell receptor β constant (TRBC) locus. Many other safe harbors have been identified by computational approaches (Pellenz et al Hum Gen Ther 30, 814-828 (2019)) and could be used for gene modifying system-mediated integration. In some embodiments, the heterologous object sequence of the template nucleic acid (e.g., template RNA) is added to the genome in an intergenic or intragenic region. In some embodiments, the heterologous object sequence of the template nucleic acid (e.g., template RNA) is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous active gene. In some embodiments, the heterologous object sequence of the template nucleic acid (e.g., template RNA) is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous promoter or enhancer. In some embodiments, the heterologous object sequence of the template nucleic acid (e.g., template RNA) can be, e.g., 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp.

The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous object sequence, wherein the reverse transcription will result in insertion of the heterologous object sequence into the target DNA. In other embodiments, the RNA template may be designed to write a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to write an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, the pre-edit homology domain comprises a nucleic acid sequence having 100% sequence identity with a nucleic acid sequence comprised in a target nucleic acid molecule.

In some embodiments, the post-edit homology domain comprises a nucleic acid sequence having 100% sequence identity with a nucleic acid sequence comprised in a target nucleic acid molecule.

PBS Sequence

In some embodiments, a template nucleic acid (e.g., template RNA) comprises a PBS sequence. In some embodiments, a PBS sequence is disposed 3' of the heterologous object sequence and is complementary to a sequence adjacent to a site to be modified by a system described herein, or comprises no more than 1, 2, 3, 4, or 5 mismatches to a sequence complementary to the sequence adjacent to a site to be modified by the system/gene modifying polypeptide. In some embodiments, the PBS sequence binds within 1, 2, 3, 4, 5, 6, 7, 8, 9, or 10 nucleotides of a nick site in the target nucleic acid molecule. In some embodiments, binding of the PBS sequence to the target nucleic acid molecule permits initiation of target-primed reverse transcription (TPRT), e.g., with the 3' homology domain acting as a primer for TPRT. In some embodiments, the PBS sequence is 3-5, 5-10, 10-30, 10-25, 10-20, 10-19, 10-18, 10-17, 10-16, 10-15, 10-14, 10-13, 10-12, 10-11, 11-30, 11-25, 11-20, 11-19, 11-18, 11-17, 11-16, 11-15, 11-14, 11-13, 11-12, 12-30, 12-25, 12-20, 12-19, 12-18, 12-17, 12-16, 12-15, 12-14, 12-13, 13-30, 13-25, 13-20, 13-19, 13-18, 13-17, 13-16, 13-15, 13-14, 14-30, 14-25, 14-20, 14-19, 14-18, 14-17, 14-16, 14-15, 15-30, 15-25, 15-20, 15-19, 15-18, 15-17, 15-16, 16-30, 16-25, 16-20, 16-19, 16-18, 16-17, 17-30, 17-25, 17-20, 17-19, 17-18, 18-30, 18-25, 18-20, 18-19, 19-30, 19-25, 19-20, 20-30, 20-25, or 25-30 nucleotides in length, e.g., 10-17, 12-16, or 12-14 nucleotides in length. In some embodiments, the PBS sequence is 5-20, 8-16, 8-14, 8-13, 9-13, 9-12, or 10-12 nucleotides in length, e.g., 9-12 nucleotides in length.

The template nucleic acid (e.g., template RNA) may have some homology to the target DNA. In some embodiments, the template nucleic acid (e.g., template RNA) PBS sequence domain may serve as an annealing region to the target DNA, such that the target DNA is positioned to prime the reverse transcription of the template nucleic acid (e.g., template RNA). In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of exact homology to the target DNA at the 3' end of the RNA. In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of at least 50%, 60%, 70%, 80%, 85%, 90%, 95%, 97%, 98%, 99% or 100% homology to the target DNA, e.g., at the 5' end of the template nucleic acid (e.g., template RNA).

gRNAs with Inducible Activity

In some embodiments, a gRNA described herein (e.g., a gRNA that is part of a template RNA or a gRNA used for second strand nicking) has inducible activity. Inducible activity may be achieved by the template nucleic acid, e.g., template RNA, further comprising (in addition to the gRNA) a blocking domain, wherein the sequence of a portion of or all of the blocking domain is at least partially complementary to a portion or all of the gRNA. The blocking domain is thus capable of hybridizing or substantially hybridizing to a portion of or all of the gRNA. In some embodiments, the blocking domain and inducibly active gRNA are disposed on the template nucleic acid, e.g., template RNA, such that the gRNA can adopt a first conformation where the blocking domain is hybridized or substantially hybridized to the gRNA, and a second conformation where the blocking domain is not hybridized or not substantially hybridized to the gRNA. In some embodiments, in the first conformation the gRNA is unable to bind to the gene modifying polypeptide (e.g., the template nucleic acid binding domain, DNA binding domain, or endonuclease domain (e.g., a CRISPR/Cas protein)) or binds with substantially decreased affinity compared to an otherwise similar template RNA lacking the blocking domain. In some embodiments, in the second conformation the gRNA is able to bind to the gene modifying polypeptide (e.g., the template nucleic acid binding domain, DNA binding domain, or endonuclease domain (e.g., a CRISPR/Cas protein)). In some embodiments, whether the gRNA is in the first or second conformation can influence whether the DNA binding or endonuclease activities of the gene modifying polypeptide (e.g., of the CRISPR/Cas protein the gene modifying polypeptide comprises) are active.

In some embodiments, the gRNA that coordinates the second nick has inducible activity. In some embodiments, the gRNA that coordinates the second nick is induced after the template is reverse transcribed. In some embodiments, hybridization of the gRNA to the blocking domain can be disrupted using an opener molecule. In some embodiments, an opener molecule comprises an agent that binds to a portion or all of the gRNA or blocking domain and inhibits hybridization of the gRNA to the blocking domain. In some embodiments, the opener molecule comprises a nucleic acid, e.g., comprising a sequence that is partially or wholly complementary to the gRNA, blocking domain, or both. By choosing or designing an appropriate opener molecule, providing the opener molecule can promote a change in the conformation of the gRNA such that it can associate with a CRISPR/Cas protein and provide the associated functions of the CRISPR/Cas protein (e.g., DNA binding and/or endonuclease activity). Without wishing to be bound by theory, providing the opener molecule at a selected time and/or location may allow for spatial and temporal control of the activity of the gRNA, CRISPR/Cas protein, or gene modifying system comprising the same. In some embodiments, the opener molecule is exogenous to the cell comprising the gene modifying polypeptide and or template nucleic acid. In some embodiments, the opener molecule comprises an endogenous agent (e.g., endogenous to the cell comprising the gene modifying polypeptide and or template nucleic acid comprising the gRNA and blocking domain). For example, an inducible gRNA, blocking domain, and opener molecule may be chosen such that the opener molecule is an endogenous agent expressed in a target cell or tissue, e.g., thereby ensuring activity of a gene modifying system in the target cell or tissue. As a further example, an inducible gRNA, blocking domain, and opener molecule may be chosen such that the opener molecule is absent or not substantially expressed in one or more non-target cells or tissues, e.g., thereby ensuring that activity of a gene modifying system does not occur or substantially occur in the one or more non-target cells or tissues, or occurs at a reduced level compared to a target cell or tissue. Exemplary blocking domains, opener molecules, and uses thereof are described in PCT App. Publication WO2020044039A1, which is incorporated herein by reference in its entirety. In some embodiments, the template nucleic acid, e.g., template RNA, may comprise one or more sequences or structures for binding by one or more components of a gene modifying polypeptide, e.g., by a reverse transcriptase or RNA binding domain, and a gRNA. In some embodiments, the gRNA facilitates interaction with the template nucleic acid binding domain (e.g., RNA binding domain) of the gene modifying polypeptide. In some embodiments, the gRNA directs the gene modifying polypeptide to the matching target sequence, e.g., in a target cell genome.

Circular RNAs and Ribozymes in Gene Modifying Systems

It is contemplated that it may be useful to employ circular and/or linear RNA states during the formulation, delivery, or gene modifying reaction within the target cell. Thus, in some embodiments of any of the aspects described herein, a gene modifying system comprises one or more circular RNAs (circRNAs). In some embodiments of any of the aspects described herein, a gene modifying system comprises one or more linear RNAs. In some embodiments, a nucleic acid as described herein (e.g., a template nucleic acid, a nucleic acid molecule encoding a gene modifying polypeptide, or both) is a circRNA. In some embodiments, a circular RNA molecule encodes the gene modifying polypeptide. In some embodiments, the circRNA molecule encoding the gene modifying polypeptide is delivered to a host cell. In some embodiments, a circular RNA molecule encodes a recombinase, e.g., as described herein. In some embodiments, the circRNA molecule encoding the recombinase is delivered to a host cell. In some embodiments, the circRNA molecule encoding the gene modifying polypeptide is linearized (e.g., in the host cell, e.g., in the nucleus of the host cell) prior to translation.

Circular RNAs (circRNAs) have been found to occur naturally in cells and have been found to have diverse functions, including both non-coding and protein coding roles in human cells. It has been shown that a circRNA can be engineered by incorporating a self-splicing intron into an RNA molecule (or DNA encoding the RNA molecule) that results in circularization of the RNA, and that an engineered circRNA can have enhanced protein production and stability (Wesselhoeft et al. *Nature Communications* 2018). In some embodiments, the gene modifying polypeptide is encoded as circRNA. In certain embodiments, the template nucleic acid is a DNA, such as a dsDNA or ssDNA. In certain embodiments, the circDNA comprises a template RNA.

In some embodiments, the circRNA comprises one or more ribozyme sequences. In some embodiments, the ribozyme sequence is activated for autocleavage, e.g., in a host cell, e.g., thereby resulting in linearization of the circRNA. In some embodiments, the ribozyme is activated when the concentration of magnesium reaches a sufficient level for cleavage, e.g., in a host cell. In some embodiments the circRNA is maintained in a low magnesium environment prior to delivery to the host cell. In some embodiments, the ribozyme is a protein-responsive ribozyme. In some embodiments, the ribozyme is a nucleic acid-responsive ribozyme. In some embodiments, the circRNA comprises a cleavage site. In some embodiments, the circRNA comprises a second cleavage site.

In some embodiments, the circRNA is linearized in the nucleus of a target cell. In some embodiments, linearization of a circRNA in the nucleus of a cell involves components present in the nucleus of the cell, e.g., to activate a cleavage event. In some embodiments, a ribozyme, e.g., a ribozyme from a B2 or ALU element, that is responsive to a nuclear element, e.g., a nuclear protein, e.g., a genome-interacting protein, e.g., an epigenetic modifier, e.g., EZH2, is incorporated into a circRNA, e.g., of a gene modifying system. In some embodiments, nuclear localization of the circRNA results in an increase in autocatalytic activity of the ribozyme and linearization of the circRNA.

In some embodiments, the ribozyme is heterologous to one or more of the other components of the gene modifying system. In some embodiments, an inducible ribozyme (e.g., in a circRNA as described herein) is created synthetically, for example, by utilizing a protein ligand-responsive aptamer design. A system for utilizing the satellite RNA of tobacco ringspot virus hammerhead ribozyme with an MS2 coat protein aptamer has been described (Kennedy et al. Nucleic Acids Res 42(19):12306-12321 (2014), incorporated herein by reference in its entirety) that results in activation of the ribozyme activity in the presence of the MS2 coat protein. In embodiments, such a system responds to protein ligand localized to the cytoplasm or the nucleus. In some embodiments the protein ligand is not MS2. Methods for generating RNA aptamers to target ligands have been described, for example, based on the systematic evolution of ligands by exponential enrichment (SELEX) (Tuerk and Gold, Science 249(4968):505-510 (1990); Ellington and Szostak, Nature 346(6287):818-822 (1990); the methods of each of which are incorporated herein by reference) and have, in some instances, been aided by in silico design (Bell et al. PNAS 117(15):8486-8493, the methods of which are incorporated herein by reference). Thus, in some embodiments, an aptamer for a target ligand is generated and incorporated into a synthetic ribozyme system, e.g., to trigger ribozyme-mediated cleavage and circRNA linearization, e.g., in the presence of the protein ligand. In some embodiments, circRNA linearization is triggered in the cytoplasm, e.g., using an aptamer that associates with a ligand in the cytoplasm. In some embodiments, circRNA linearization is triggered in the nucleus, e.g., using an aptamer that associates with a ligand in the nucleus. In embodiments, the ligand in the nucleus comprises an epigenetic modifier or a transcription factor. In some embodiments the ligand that triggers linearization is present at higher levels in on-target cells than off-target cells.

It is further contemplated that a nucleic acid-responsive ribozyme system can be employed for circRNA linearization. For example, biosensors that sense defined target nucleic acid molecules to trigger ribozyme activation are described, e.g., in Penchovsky (Biotechnology Advances 32(5):1015-1027 (2014), incorporated herein by reference). By these methods, a ribozyme naturally folds into an inactive state and is only activated in the presence of a defined target nucleic acid molecule (e.g., an RNA molecule). In some embodiments, a circRNA of a gene modifying system comprises a nucleic acid-responsive ribozyme that is activated in the presence of a defined target nucleic acid, e.g., an RNA, e.g., an mRNA, miRNA, guide RNA, gRNA, sgRNA, ncRNA, 1ncRNA, tRNA, snRNA, or mtRNA. In some embodiments the nucleic acid that triggers linearization is present at higher levels in on-target cells than off-target cells.

In some embodiments of any of the aspects herein, a gene modifying system incorporates one or more ribozymes with inducible specificity to a target tissue or target cell of interest, e.g., a ribozyme that is activated by a ligand or nucleic acid present at higher levels in a target tissue or target cell of interest. In some embodiments, the gene modifying system incorporates a ribozyme with inducible specificity to a subcellular compartment, e.g., the nucleus, nucleolus, cytoplasm, or mitochondria. In some embodiments, the ribozyme that is activated by a ligand or nucleic acid present at higher levels in the target subcellular compartment. In some embodiments, an RNA component of a gene modifying system is provided as circRNA, e.g., that is activated by linearization. In some embodiments, linearization of a circRNA encoding a gene modifying polypeptide activates the molecule for translation. In some embodiments, a signal that activates a circRNA component of a gene modifying system is present at higher levels in on-target cells or tissues, e.g., such that the system is specifically activated in these cells.

In some embodiments, an RNA component of a gene modifying system is provided as a circRNA that is inactivated by linearization. In some embodiments, a circRNA encoding the gene modifying polypeptide is inactivated by cleavage and degradation. In some embodiments, a circRNA encoding the gene modifying polypeptide is inactivated by cleavage that separates a translation signal from the coding sequence of the polypeptide. In some embodiments, a signal that inactivates a circRNA component of a gene modifying system is present at higher levels in off-target cells or tissues, such that the system is specifically inactivated in these cells.

Target Nucleic Acid Site

In some embodiments, after gene modification, the target site surrounding the edited sequence contains a limited number of insertions or deletions, for example, in less than about 50% or 10% of editing events, e.g., as determined by long-read amplicon sequencing of the target site, e.g., as described in Karst et al. (2020) bioRxiv doi.org/10.1101/645903 (incorporated by reference herein in its entirety). In some embodiments, the target site does not show multiple consecutive editing events, e.g., head-to-tail or head-to-head duplications, e.g., as determined by long-read amplicon sequencing of the target site, e.g., as described in Karst et al. bioRxiv doi.org/10.1101/645903 (2020) (incorporated herein by reference in its entirety). In some embodiments, the target site contains an integrated sequence corresponding to the template RNA. In some embodiments, the target site does not contain insertions resulting from endogenous RNA in more than about 1% or 10% of events, e.g., as determined by long-read amplicon sequencing of the target site, e.g., as described in Karst et al. bioRxiv doi.org/10.1101/645903

(2020) (incorporated herein by reference in its entirety). In some embodiments, the target site contains the integrated sequence corresponding to the template RNA.

In certain aspects of the present invention, the host DNA-binding site integrated into by the gene modifying system can be in a gene, in an intron, in an exon, an ORF, outside of a coding region of any gene, in a regulatory region of a gene, or outside of a regulatory region of a gene. In other aspects, the polypeptide may bind to one or more than one host DNA sequence.

In some embodiments, a gene modifying system is used to edit a target locus in multiple alleles. In some embodiments, a gene modifying system is designed to edit a specific allele. For example, a gene modifying polypeptide may be directed to a specific sequence that is only present on one allele, e.g., comprises a template RNA with homology to a target allele, e.g., a gRNA or annealing domain, but not to a second cognate allele. In some embodiments, a gene modifying system can alter a haplotype-specific allele. In some embodiments, a gene modifying system that targets a specific allele preferentially targets that allele, e.g., has at least a 2, 4, 6, 8, or 10-fold preference for a target allele.

Second Strand Nicking

In some embodiments, a gene modifying system described herein comprises a nickase activity (e.g., in the gene modifying polypeptide) that nicks the first strand, and a nickase activity (e.g., in a polypeptide separate from the gene modifying polypeptide) that nicks the second strand of target DNA. As discussed herein, without wishing to be bound by theory, nicking of the first strand of the target site DNA is thought to provide a 3' OH that can be used by an RT domain to reverse transcribe a sequence of a template RNA, e.g., a heterologous object sequence. Without wishing to be bound by theory, it is thought that introducing an additional nick to the second strand may bias the cellular DNA repair machinery to adopt the heterologous object sequence-based sequence more frequently than the original genomic sequence. In some embodiments, the additional nick to the second strand is made by the same endonuclease domain (e.g., nickase domain) as the nick to the first strand. In some embodiments, the same gene modifying polypeptide performs both the nick to the first strand and the nick to the second strand. In some embodiments, the gene modifying polypeptide comprises a CRISPR/Cas domain and the additional nick to the second strand is directed by an additional nucleic acid, e.g., comprising a second gRNA directing the CRISPR/Cas domain to nick the second strand. In other embodiments, the additional second strand nick is made by a different endonuclease domain (e.g., nickase domain) than the nick to the first strand. In some embodiments, that different endonuclease domain is situated in an additional polypeptide (e.g., a system of the invention further comprises the additional polypeptide), separate from the gene modifying polypeptide. In some embodiments, the additional polypeptide comprises an endonuclease domain (e.g., nickase domain) described herein. In some embodiments, the additional polypeptide comprises a DNA binding domain, e.g., described herein.

It is contemplated herein that the position at which the second strand nick occurs relative to the first strand nick may influence the extent to which one or more of: desired gene modifying DNA modifications are obtained, undesired double-strand breaks (DSBs) occur, undesired insertions occur, or undesired deletions occur. Without wishing to be bound by theory, second strand nicking may occur in two general orientations: inward nicks and outward nicks.

In some embodiments, in the inward nick orientation, the RT domain polymerizes (e.g., using the template RNA (e.g., the heterologous object sequence)) away from the second strand nick. In some embodiments, in the inward nick orientation, the location of the nick to the first strand and the location of the nick to the second strand are positioned between the first PAM site and second PAM site (e.g., in a scenario wherein both nicks are made by a polypeptide (e.g., a gene modifying polypeptide) comprising a CRISPR/Cas domain). When there are two PAMs on the outside and two nicks on the inside, this inward nick orientation can also be referred to as "PAM-out". In some embodiments, in the inward nick orientation, the location of the nick to the first strand and the location of the nick to the second strand are between the sites where the polypeptide and the additional polypeptide bind to the target DNA. In some embodiments, in the inward nick orientation, the location of the nick to the second strand is positioned between the binding sites of the polypeptide and additional polypeptide, and the nick to the first strand is also located between the binding sites of the polypeptide and additional polypeptide. In some embodiments, in the inward nick orientation, the location of the nick to the first strand and the location of the nick to the second strand are positioned between the PAM site and the binding site of the second polypeptide which is at a distance from the target site.

An example of a gene modifying system that provides an inward nick orientation comprises a gene modifying polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are between the PAM sites of the sites to which the two gRNAs direct the gene modifying polypeptide. As a further example, another gene modifying system that provides an inward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are between the PAM site and the site to which the zinc finger molecule binds. As a further example, another gene modifying system that provides an inward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are between the site to which the TAL effector molecule binds and the site to which the zinc finger molecule binds.

In some embodiments, in the outward nick orientation, the RT domain polymerizes (e.g., using the template RNA (e.g., the heterologous object sequence)) toward the second strand nick. In some embodiments, in the outward nick orientation when both the first and second nicks are made by a polypeptide comprising a CRISPR/Cas domain (e.g., a gene modifying polypeptide), the first PAM site and second PAM site are positioned between the location of the nick to the first strand and the location of the nick to the second strand. When there are two PAMs on the inside and two nicks on the outside, this outward nick orientation also can be referred to as "PAM-in". In some embodiments, in the outward nick orientation, the polypeptide (e.g., the gene modifying polypeptide) and the additional polypeptide bind to sites on the target DNA between the location of the nick to the first strand and the location of the nick to the second. In some embodiments, in the outward nick orientation, the location of the nick to the second strand is positioned on the opposite side of the binding sites of the polypeptide and additional polypeptide relative to the location of the nick to the first strand. In some embodiments, in the outward orientation, the PAM site and the binding site of the second polypeptide which is at a distance from the target site are positioned between the location of the nick to the first strand and the location of the nick to the second strand.

An example of a gene modifying system that provides an outward nick orientation comprises a gene modifying polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are outside of the PAM sites of the sites to which the two gRNAs direct the gene modifying polypeptide (i.e., the PAM sites are between the location of the first nick and the location of the second nick). As a further example, another gene modifying system that provides an outward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are outside the PAM site and the site to which the zinc finger molecule binds (i.e., the PAM site and the site to which the zinc finger molecule binds are between the location of the first nick and the location of the second nick). As a further example, another gene modifying system that provides an outward nick orientation comprises a gene modifying polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are outside the site to which the TAL effector molecule binds and the site to which the zinc finger molecule binds (i.e., the site to which the TAL effector molecule binds and the site to which the zinc finger molecule binds are between the location of the first nick and the location of the second nick).

Without wishing to be bound by theory, it is thought that, for gene modifying systems where a second strand nick is provided, an outward nick orientation is preferred in some embodiments. As is described herein, an inward nick may produce a higher number of double-strand breaks (DSBs) than an outward nick orientation. DSBs may be recognized by the DSB repair pathways in the nucleus of a cell, which can result in undesired insertions and deletions. An outward nick orientation may provide a decreased risk of DSB formation, and a corresponding lower amount of undesired insertions and deletions. In some embodiments, undesired insertions and deletions are insertions and deletions not encoded by the heterologous object sequence, e.g., an insertion or deletion produced by the double-strand break repair pathway unrelated to the modification encoded by the heterologous object sequence. In some embodiments, a desired gene modification comprises a change to the target DNA (e.g., a substitution, insertion, or deletion) encoded by the heterologous object sequence (e.g., and achieved by the gene modifying writing the heterologous object sequence into the target site). In some embodiments, the first strand nick and the second strand nick are in an outward orientation.

In addition, the distance between the first strand nick and second strand nick may influence the extent to which one or more of: desired gene modifying system DNA modifications are obtained, undesired double-strand breaks (DSBs) occur, undesired insertions occur, or undesired deletions occur. Without wishing to be bound by theory, it is thought the second strand nick benefit, the biasing of DNA repair toward incorporation of the heterologous object sequence into the target DNA, increases as the distance between the first strand nick and second strand nick decreases. However, it is thought that the risk of DSB formation also increases as the distance between the first strand nick and second strand nick decreases. Correspondingly, it is thought that the number of undesired insertions and/or deletions may increase as the distance between the first strand nick and second strand nick decreases. In some embodiments, the distance between the first strand nick and second strand nick is chosen to balance the benefit of biasing DNA repair toward incorporation of the heterologous object sequence into the target DNA and the risk of DSB formation and of undesired deletions and/or insertions. In some embodiments, a system where the first strand nick and the second strand nick are at least a threshold distance apart has an increased level of desired gene modifying system modification outcomes, a decreased level of undesired deletions, and/or a decreased level of undesired insertions relative to an otherwise similar inward nick orientation system where the first nick and the second nick are less than the a threshold distance apart. In some embodiments the threshold distance(s) is given below.

In some embodiments, the first nick and the second nick are at least 20, 25, 30, 35, 40, 45, 50, 55, 60, 65, 70, 75, 80, 85, 90, 95, 100, 110, 120, 130, 140, 150, 160, 170, 180, 190, or 200 nucleotides apart. In some embodiments, the first nick and the second nick are no more than 25, 30, 35, 40, 45, 50, 55, 60, 65, 70, 75, 80, 85, 90, 95, 100, 110, 120, 130, 140, 150, 160, 170, 180, 190, 200, or 250 nucleotides apart. In some embodiments, the first nick and the second nick are 20-200, 30-200, 40-200, 50-200, 60-200, 70-200, 80-200, 90-200, 100-200, 110-200, 120-200, 130-200, 140-200, 150-200, 160-200, 170-200, 180-200, 190-200, 20-190, 30-190, 40-190, 50-190, 60-190, 70-190, 80-190, 90-190, 100-190, 110-190, 120-190, 130-190, 140-190, 150-190, 160-190, 170-190, 180-190, 20-180, 30-180, 40-180, 50-180, 60-180, 70-180, 80-180, 90-180, 100-180, 110-180, 120-180, 130-180, 140-180, 150-180, 160-180, 170-180, 20-170, 30-170, 40-170, 50-170, 60-170, 70-170, 80-170, 90-170, 100-170, 110-170, 120-170, 130-170, 140-170, 150-170, 160-170, 20-160, 30-160, 40-160, 50-160, 60-160, 70-160, 80-160, 90-160, 100-160, 110-160, 120-160, 130-160, 140-160, 150-160, 20-150, 30-150, 40-150, 50-150, 60-150, 70-150, 80-150, 90-150, 100-150, 110-150, 120-150, 130-150, 140-150, 20-140, 30-140, 40-140, 50-140, 60-140, 70-140, 80-140, 90-140, 100-140, 110-140, 120-140, 130-140, 20-130, 30-130, 40-130, 50-130, 60-130, 70-130, 80-130, 90-130, 100-130, 110-130, 120-130, 20-120, 30-120, 40-120, 50-120, 60-120, 70-120, 80-120, 90-120, 100-120, 110-120, 20-110, 30-110, 40-110, 50-110, 60-110, 70-110, 80-110, 90-110, 100-110, 20-100, 30-100, 40-100, 50-100, 60-100, 70-100, 80-100, 90-100, 20-90, 30-90, 40-90, 50-90, 60-90, 70-90, 80-90, 20-80, 30-80, 40-80, 50-80, 60-80, 70-80, 20-70, 30-70, 40-70, 50-70, 60-70, 20-60, 30-60, 40-60, 50-60, 20-50, 30-50, 40-50, 20-40, 30-40, or 20-30 nucleotides apart. In some embodiments, the first nick and the second nick are 40-100 nucleotides apart.

Without wishing to be bound by theory, it is thought that, for gene modifying systems where a second strand nick is provided and an inward nick orientation is selected, increasing the distance between the first strand nick and second strand nick may be preferred. As is described herein, an inward nick orientation may produce a higher number of DSBs than an outward nick orientation, and may result in a higher amount of undesired insertions and deletions than an outward nick orientation, but increasing the distance between the nicks may mitigate that increase in DSBs, undesired deletions, and/or undesired insertions. In some embodiments, an inward nick orientation wherein the first nick and the second nick are at least a threshold distance apart has an increased level of desired gene modifying system modification outcomes, a decreased level of undesired deletions, and/or a decreased level of undesired insertions relative to an otherwise similar inward nick orientation system where the first nick and the second nick are less than the threshold distance apart. In some embodiments the threshold distance is given below.

In some embodiments, the first strand nick and the second strand nick are in an inward orientation. In some embodiments, the first strand nick and the second strand nick are in an inward orientation and the first strand nick and second strand nick are at least 100, 110, 120, 130, 140, 150, 160, 170, 180, 190, 200, 220, 240, 260, 280, 300, 350, 400, 450, or 500 nucleotides apart, e.g., at least 100 nucleotides apart, (and optionally no more than 500, 400, 300, 200, 190, 180, 170, 160, 150, 140, 130, or 120 nucleotides apart). In some embodiments, the first strand nick and the second strand nick are in an inward orientation and the first strand nick and second strand nick are 100-200, 110-200, 120-200, 130-200, 140-200, 150-200, 160-200, 170-200, 180-200, 190-200, 100-190, 110-190, 120-190, 130-190, 140-190, 150-190, 160-190, 170-190, 180-190, 100-180, 110-180, 120-180, 130-180, 140-180, 150-180, 160-180, 170-180, 100-170, 110-170, 120-170, 130-170, 140-170, 150-170, 160-170, 100-160, 110-160, 120-160, 130-160, 140-160, 150-160, 100-150, 110-150, 120-150, 130-150, 140-150, 100-140, 110-140, 120-140, 130-140, 100-130, 110-130, 120-130, 100-120, 110-120, or 100-110 nucleotides apart.

Chemically Modified Nucleic Acids and Nucleic Acid End Features

A nucleic acid described herein (e.g., a template nucleic acid, e.g., a template RNA; or a nucleic acid (e.g., mRNA) encoding a gene modifying polypeptide; or a gRNA) can comprise unmodified or modified nucleobases. Naturally occurring RNAs are synthesized from four basic ribonucleotides: ATP, CTP, UTP and GTP, but may contain post-transcriptionally modified nucleotides. Further, approximately one hundred different nucleoside modifications have been identified in RNA (Rozenski, J, Crain, P, and McCloskey, J. (1999). The RNA Modification Database: 1999 update. Nucl Acids Res 27: 196-197). An RNA can also comprise wholly synthetic nucleotides that do not occur in nature.

In some embodiments, the chemical modification is one provided in WO/2016/183482, US Pat. Pub. No. 20090286852, of International Application No. WO/2012/019168, WO/2012/045075, WO/2012/135805, WO/2012/158736, WO/2013/039857, WO/2013/039861, WO/2013/052523, WO/2013/090648, WO/2013/096709, WO/2013/101690, WO/2013/106496, WO/2013/130161, WO/2013/151669, WO/2013/151736, WO/2013/151672, WO/2013/151664, WO/2013/151665, WO/2013/151668, WO/2013/151671, WO/2013/151667, WO/2013/151670, WO/2013/151666, WO/2013/151663, WO/2014/028429, WO/2014/081507, WO/2014/093924, WO/2014/093574, WO/2014/113089, WO/2014/144711, WO/2014/144767, WO/2014/144039, WO/2014/152540, WO/2014/152030, WO/2014/152031, WO/2014/152027, WO/2014/152211, WO/2014/158795, WO/2014/159813, WO/2014/164253, WO/2015/006747, WO/2015/034928, WO/2015/034925, WO/2015/038892, WO/2015/048744, WO/2015/051214, WO/2015/051173, WO/2015/051169, WO/2015/058069, WO/2015/085318, WO/2015/089511, WO/2015/105926, WO/2015/164674, WO/2015/196130, WO/2015/196128, WO/2015/196118, WO/2016/011226, WO/2016/011222, WO/2016/011306, WO/2016/014846, WO/2016/022914, WO/2016/036902, WO/2016/077125, or WO/2016/077123, each of which is herein incorporated by reference in its entirety. It is understood that incorporation of a chemically modified nucleotide into a polynucleotide can result in the modification being incorporated into a nucleobase, the backbone, or both, depending on the location of the modification in the nucleotide. In some embodiments, the backbone modification is one provided in EP 2813570, which is herein incorporated by reference in its entirety. In some embodiments, the modified cap is one provided in US Pat. Pub. No. 20050287539, which is herein incorporated by reference in its entirety.

In some embodiments, the chemically modified nucleic acid (e.g., RNA, e.g., mRNA) comprises one or more of ARCA: anti-reverse cap analog (m27.3'-OGP3G), GP3G (Unmethylated Cap Analog), m7GP3G (Monomethylated Cap Analog), m32.2.7GP3G (Trimethylated Cap Analog), m5CTP (5'-methyl-cytidine triphosphate), m6ATP (N6-methyl-adenosine-5'-triphosphate), s2UTP (2-thio-uridine triphosphate), and Ψ (pseudouridine triphosphate).

In some embodiments, the chemically modified nucleic acid comprises a 5' cap, e.g.: a 7-methylguanosine cap (e.g., a O-Me-m7G cap); a hypermethylated cap analog; an NAD+-derived cap analog (e.g., as described in Kiledjian, Trends in Cell Biology 28, 454-464 (2018)); or a modified, e.g., biotinylated, cap analog (e.g., as described in Bednarek et al., Phil Trans R Soc B 373, 20180167 (2018)).

In some embodiments, the chemically modified nucleic acid comprises a 3' feature selected from one or more of: a polyA tail; a 16-nucleotide long stem-loop structure flanked by unpaired 5 nucleotides (e.g., as described by Mannironi et al., Nucleic Acid Research 17, 9113-9126 (1989)); a triple-helical structure (e.g., as described by Brown et al., PNAS 109, 19202-19207 (2012)); a tRNA, Y RNA, or vault RNA structure (e.g., as described by Labno et al., Biochemica et Biophysica Acta 1863, 3125-3147 (2016)); incorporation of one or more deoxyribonucleotide triphosphates (dNTPs), 2'O-Methylated NTPs, or phosphorothioate-NTPs; a single nucleotide chemical modification (e.g., oxidation of the 3' terminal ribose to a reactive aldehyde followed by conjugation of the aldehyde-reactive modified nucleotide); or chemical ligation to another nucleic acid molecule.

In some embodiments, the nucleic acid (e.g., template nucleic acid) comprises one or more modified nucleotides, e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (pU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Ψ), 1-N-methylpseudouridine (1-Me-Ψ), or 5-methoxyuridine (5-MO-U).

In some embodiments, the nucleic acid comprises a backbone modification, e.g., a modification to a sugar or phosphate group in the backbone. In some embodiments, the nucleic acid comprises a nucleobase modification.

In some embodiments, the nucleic acid comprises one or more chemically modified nucleotides of Table 13, one or more chemical backbone modifications of Table 14, one or more chemically modified caps of Table 15. For instance, in some embodiments, the nucleic acid comprises two or more (e.g., 3, 4, 5, 6, 7, 8, 9, or 10 or more) different types of chemical modifications. As an example, the nucleic acid may comprise two or more (e.g., 3, 4, 5, 6, 7, 8, 9, or 10 or more) different types of modified nucleobases, e.g., as described herein, e.g., in Table 13. Alternatively or in combination, the nucleic acid may comprise two or more (e.g., 3, 4, 5, 6, 7, 8, 9, or 10 or more) different types of backbone modifications, e.g., as described herein, e.g., in Table 14. Alternatively or in combination, the nucleic acid may comprise one or more modified cap, e.g., as described herein, e.g., in Table 15. For instance, in some embodiments, the nucleic acid comprises one or more type of modified nucleobase and one or more type of backbone modification; one or more type of modified nucleobase and one or more modified cap; one or more type of modified cap and one or more type of backbone modification; or one or more type of modified nucleobase, one or more type of backbone modification, and one or more type of modified cap.

In some embodiments, the nucleic acid comprises one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) modified nucleobases. In some embodiments, all nucleobases of the nucleic acid are modified. In some embodiments, the nucleic acid is modified at one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) positions in the backbone. In some embodiments, all backbone positions of the nucleic acid are modified.

TABLE 13

| Modified nucleotides | |
|---|---|
| 5-aza-uridine | N2-methyl-6-thio-guanosine |
| 2-thio-5-aza-midine | N2,N2-dimethyl-6-thio-guanosine |
| 2-thiouridine | pyridin-4-one ribonucleoside |
| 4-thio-pseudouridine | 2-thio-5-aza-uridine |
| 2-thio-pseudouridine | 2-thiomidine |
| 5-hydroxyuridine | 4-thio-pseudomidine |
| 3-methyluridine | 2-thio-pseudowidine |
| 5-carboxymethyl-uridine | 3-methylmidine |
| 1-carboxymethyl-pseudouridine | 1-propynyl-pseudomidine |
| 5-propynyl-uridine | 1-methyl-1-deaza-pseudomidine |
| 1-propynyl-pseudouridine | 2-thio-1-methyl-1-deaza-pseudouridine |
| 5-taurinomethyluridine | 4-methoxy-pseudomidine |
| 1-taurinomethyl-pseudouridine | 5'-O-(1-Thiophosphate)-Adenosine |
| 5-taurinomethyl-2-thio-uridine | 5'-O-(1-Thiophosphate)-Cytidine |
| 1-taurinomethyl-4-thio-uridine | 5'-O-(1-thiophosphate)-Guanosine |
| 5-methyl-uridine | 5'-O-(1-Thiophophate)-Uridine |
| 1-methyl-pseudouridine | 5'-O-(1-Thiophosphate)-Pseudouridine |
| 4-thio-1-methyl-pseudouridine | 2'-O-methyl-Adenosine |
| 2-thio-1-methyl-pseudouridine | 2'-O-methyl-Cytidine |
| 1-methyl-1-deaza-pseudouridine | 2'-O-methyl-Guanosine |
| 2-thio-1-methyl-1-deaza-pseudomidine | 2'-O-methyl-Uridine |
| dihydrouridine | 2'-O-methyl-Pseudouridine |
| dihydropseudouridine | 2'-O-methyl-Inosine |
| 2-thio-dihydromidine | 2-methyladenosine |
| 2-thio-dihydropseudouridine | 2-methylthio-N6-methyladenosine |
| 2-methoxyuridine | 2-methylthio-N6 isopentenyladenosine |
| 2-methoxy-4-thio-uridine | 2-methylthio-N6-(cis-hydroxyisopentenyl)adenosine |
| 4-methoxy-pseudouridine | |
| 4-methoxy-2-thio-pseudouridine | N6-methyl-N6-threonylcarbamoyladenosine |
| 5-aza-cytidine | N6-hydroxynorvalylcarbamoyladenosine |
| pseudoisocytidine | 2-methylthio-N6-hydroxynorvalyl carbamoyladenosine |
| 3-methyl-cytidine | |
| N4-acetylcytidine | 2'-O-ribosyladenosine (phosphate) |
| 5-formylcytidine | 1,2'-O-dimethylinosine |
| N4-methylcytidine | 5,2'-O-dimethylcytidine |
| 5-hydroxymethylcytidine | N4-acetyl-2'-O-methylcytidine |
| 1-methyl-pseudoisocytidine | Lysidine |
| pyrrolo-cytidine | 7-methylguanosine |
| pyrrolo-pseudoisocytidine | N2,2'-O-dimethylguanosine |
| 2-thio-cytidine | N2,N2,2'-O-trimethylguanosine |

TABLE 13-continued

| Modified nucleotides | |
|---|---|
| 2-thio-5-methyl-cytidine | 2'-O-ribosylguanosine (phosphate) |
| 4-thio-pseudoisocytidine | Wybutosine |
| 4-thio-1-methyl-pseudoisocytidine | Peroxywybutosine |
| 4-thio-1-methyl-1-deaza-pseudoisocytidine | Hydroxywybutosine |
| 1-methyl-1-deaza-pseudoisocytidine | undermodified hydroxywybutosine |
| zebularine | methylwyosine |
| 5-aza-zebularine | queuosine |
| 5-methyl-zebularine | epoxyqueuosine |
| 5-aza-2-thio-zebularine | galactosyl-queuosine |
| 2-thio-zebularine | mannosyl-queuosine |
| 2-methoxy-cytidine | 7-cyano-7-deazaguanosine |
| 2-methoxy-5-methyl-cytidine | 7-aminomethyl-7-deazaguanosine |
| 4-methoxy-pseudoisocytidine | archaeosine |
| 4-methoxy-1-methyl-pseudoisocytidine | 5,2'-O-dimethyluridine |
| 2-aminopurine | 4-thiouridine |
| 2,6-diaminopurine | 5-methyl-2-thiouridine |
| 7-deaza-adenine | 2-thio-2'-O-methyluridine |
| 7-deaza-8-aza-adenine | 3-(3-amino-3-carboxypropyl)uridine |
| 7-deaza-2-aminopurine | 5-methoxyuridine |
| 7-deaza-8-aza-2-aminopurine | uridine 5-oxyacetic acid |
| 7-deaza-2,6-diaminopurine | uridine 5-oxyacetic acid methyl ester |
| 7-deaza-8-aza-2,6-diaminopurine | 5-(carboxyhydroxymethyl)uridine) |
| 1-methyladenosine | 5-(carboxyhydroxymethyl)uridine methyl ester |
| N6-isopentenyladenosine | 5-methoxycarbonylmethyluridine |
| N6-(cis-hydroxyisopentenyl)adenosine | 5-methoxycarbonylmethyl-2'-O-methyluridine |
| 2-methylthio-N6-(cis-hydroxyisopentenyl) adenosine | 5-methoxycarbonylmethyl-2-thiouridine |
| | 5-aminomethyl-2-thiouridine |
| N6-glycinylcarbamoyladenosine | 5-methylaminomethyluridine |
| N6-threonylcarbamoyladenosine | 5-methylaminomethyl-2-thiouridine |
| 2-methylthio-N6-threonyl carbamoyladenosine | 5-methylaminomethyl-2-selenouridine |
| N6,N6-dimethyladenosine | 5-carbamoylmethyluridine |
| 7-methyladenine | 5-carbamoylmethyl-2'-O-methyluridine |
| 2-methylthio-adenine | 5-carboxymethylaminomethyluridine |
| 2-methoxy-adenine | 5-carboxymethylaminomethyl-2'-O-methyluridine |
| inosine | 5-carboxymethylaminomethyl-2-thiouridine |
| 1-methyl-inosine | N4,2'-O-dimethylcytidine |
| wyosine | 5-carboxymethyluridine |
| wybutosine | N6,2'-O-dimethyladenosine |
| 7-deaza-guanosine | N,N6,O-2'-trimethyladenosine |
| 7-deaza-8-aza-guanosine | N2,7-dimethylguanosine |
| 6-thio-guanosine | N2,N2,7-trimethylguanosine |
| 6-thio-7-deaza-guanosine | 3,2'-O-dimethyluridine |
| 6-thio-7-deaza-8-aza-guanosine | 5-methyldihydrouridine |
| 7-methyl-guanosine | 5-formyl-2'-O-methylcytidine |
| 6-thio-7-methyl-guanosine | 1,2'-O-dimethylguanosine |
| 7-methylinosine | 4-demethylwyosine |
| 6-methoxy-guanosine | Isowyosine |
| 1-methylguanosine | N6-acetyladenosine |
| N2-methylguanosine | |
| N2,N2-dimethylguanosine | |
| 8-oxo-guanosine | |
| 7-methyl-8-oxo-guanosine | |
| 1-methyl-6-thio-guanosine | |

TABLE 14

| Backbone modifications |
|---|
| 2'-O-Methyl backbone |
| Peptide Nucleic Acid (PNA) backbone |
| phosphorothioate backbone |
| morpholino backbone |
| carbamate backbone |
| siloxane backbone |
| sulfide backbone |
| sulfoxide backbone |
| sulfone backbone |
| formacetyl backbone |
| thioformacetyl backbone |
| methyleneformacetyl backbone |
| riboacetyl backbone |
| alkene containing backbone |
| sulfamate backbone |
| sulfonate backbone |
| sulfonamide backbone |
| methyleneimino backbone |
| methylenehydrazino backbone |
| amide backbone |

TABLE 15

| Modified caps |
|---|
| m7GpppA |
| m7GpppC |
| m2,7GpppG |
| m2,2,7GpppG |
| m7Gpppm7G |
| m7,2'OmeGpppG |
| m72'dGpppG |

TABLE 15-continued

Modified caps m7,3'OmeGpppG
m7,3'dGpppG
GppppG
m7GppppG
m7GppppA
m7GppppC
m2,7GppppG
m2,2,7GppppG
m7Gppppm7G
m7,2'OmeGppppG
m72'dGppppG
m7,3'OmeGppppG
m7,3'dGppppG The nucleotides comprising the template of the gene modifying system can be natural or modified bases, or a combination thereof. For example, the template may contain pseudouridine, dihydrouridine, inosine, 7-methylguanosine, or other modified bases. In some embodiments, the template may contain locked nucleic acid nucleotides. In some embodiments, the modified bases used in the template do not inhibit the reverse transcription of the template. In some embodiments, the modified bases used in the template may improve reverse transcription, e.g., specificity or fidelity.

In some embodiments, an RNA component of the system (e.g., a template RNA or a gRNA) comprises one or more nucleotide modifications. In some embodiments, the modification pattern of a gRNA can significantly affect in vivo activity compared to unmodified or end-modified guides (e.g., as shown in FIG. 1D from Finn et al. *Cell Rep* 22(9):2227-2235 (2018); incorporated herein by reference in its entirety). Without wishing to be bound by theory, this process may be due, at least in part, to a stabilization of the RNA conferred by the modifications. Non-limiting examples of such modifications may include 2'-O-methyl (2'-O-Me), 2'-O-(2-methoxyethyl) (2'-O-MOE), 2'-fluoro (2'-F), phosphorothioate (PS) bond between nucleotides, G-C substitutions, and inverted abasic linkages between nucleotides and equivalents thereof.

In some embodiments, the template RNA (e.g., at the portion thereof that binds a target site) or the guide RNA comprises a 5' terminus region. In some embodiments, the template RNA or the guide RNA does not comprise a 5' terminus region. In some embodiments, the 5' terminus region comprises a gRNA spacer region, e.g., as described with respect to sgRNA in Briner A E et al, Molecular Cell 56: 333-339 (2014) (incorporated herein by reference in its entirety; applicable herein, e.g., to all guide RNAs). In some embodiments, the 5' terminus region comprises a 5' end modification. In some embodiments, a 5' terminus region with or without a spacer region may be associated with a crRNA, trRNA, sgRNA and/or dgRNA. The gRNA spacer region can, in some instances, comprise a guide region, guide domain, or targeting domain.

In some embodiments, the template RNAs (e.g., at the portion thereof that binds a target site) or guide RNAs described herein comprises any of the sequences shown in Table 4 of WO2018107028A1, incorporated herein by reference in its entirety. In some embodiments, where a sequence shows a guide and/or spacer region, the composition may comprise this region or not. In some embodiments, a guide RNA comprises one or more of the modifications of any of the sequences shown in Table 4 of WO2018107028A1, e.g., as identified therein by a SEQ ID NO. In embodiments, the nucleotides may be the same or different, and/or the modification pattern shown may be the same or similar to a modification pattern of a guide sequence as shown in Table 4 of WO2018107028A1. In some embodiments, a modification pattern includes the relative position and identity of modifications of the gRNA or a region of the gRNA (e.g. 5' terminus region, lower stem region, bulge region, upper stem region, nexus region, hairpin 1 region, hairpin 2 region, 3' terminus region). In some embodiments, the modification pattern contains at least 50%, 55%, 60%, 70%, 75%, 80%, 85%, 90%, 95%, 96%, 97%, 98%, 99%, or 100% of the modifications of any one of the sequences shown in the sequence column of Table 4 of WO2018107028A1, and/or over one or more regions of the sequence. In some embodiments, the modification pattern is at least 50%, 55%, 60%, 70%, 75%, 80%, 85%, 90%, 95%, 96%, 97%, 98%, 99%, or 100% identical to the modification pattern of any one of the sequences shown in the sequence column of Table 4 of WO2018107028A1. In some embodiments, the modification pattern is at least 50%, 55%, 60%, 70%, 75%, 80%, 85%, 90%, 95%, 96%, 97%, 98%, 99%, or 100% identical over one or more regions of the sequence shown in Table 4 of WO2018107028A1, e.g., in a 5' terminus region, lower stem region, bulge region, upper stem region, nexus region, hairpin 1 region, hairpin 2 region, and/or 3' terminus region. In some embodiments, the modification pattern is least 50%, 55%, 60%, 70%, 75%, 80%, 85%, 90%, 95%, 96%, 97%, 98%, 99%, or 100% identical to the modification pattern of a sequence over the 5' terminus region. In some embodiments, the modification pattern is least 50%, 55%, 60%, 70%, 75%, 80%, 85%, 90%, 95%, 96%, 97%, 98%, 99%, or 100% identical over the lower stem. In some embodiments, the modification pattern is least 50%, 55%, 60%, 70%, 75%, 80%, 85%, 90%, 95%, 96%, 97%, 98%, 99%, or 100% identical over the bulge. In some embodiments, the modification pattern is least 50%, 55%, 60%, 70%, 75%, 80%, 85%, 90%, 95%, 96%, 97%, 98%, 99%, or 100% identical over the upper stem. In some embodiments, the modification pattern is least 50%, 55%, 60%, 70%, 75%, 80%, 85%, 90%, 95%, 96%, 97%, 98%, 99%, or 100% identical over the nexus. In some embodiments, the modification pattern is least 50%, 55%, 60%, 70%, 75%, 80%, 85%, 90%, 95%, 96%, 97%, 98%, 99%, or 100% identical over the hairpin 1. In some embodiments, the modification pattern is least 50%, 55%, 60%, 70%, 75%, 80%, 85%, 90%, 95%, 96%, 97%, 98%, 99%, or 100% identical over the hairpin 2. In some embodiments, the modification pattern is least 50%, 55%, 60%, 70%, 75%, 80%, 85%, 90%, 95%, 96%, 97%, 98%, 99%, or 100% identical over the 3' terminus. In some embodiments, the modification pattern differs from the modification pattern of a sequence of Table 4 of WO2018107028A1, or a region (e.g. 5' terminus, lower stem, bulge, upper stem, nexus, hairpin 1, hairpin 2, 3' terminus) of such a sequence, e.g., at 0, 1, 2, 3, 4, 5, 6, or more nucleotides. In some embodiments, the gRNA comprises modifications that differ from the modifications of a sequence of Table 4 of WO2018107028A1, e.g., at 0, 1, 2, 3, 4, 5, 6, or more nucleotides. In some embodiments, the gRNA comprises modifications that differ from modifications of a region (e.g. 5' terminus, lower stem, bulge, upper stem, nexus, hairpin 1, hairpin 2, 3' terminus) of a sequence of Table 4 of WO2018107028A1, e.g., at 0, 1, 2, 3, 4, 5, 6, or more nucleotides.

In some embodiments, the template RNAs (e.g., at the portion thereof that binds a target site) or the gRNA comprises a 2'-O-methyl (2'-O-Me) modified nucleotide. In some embodiments, the gRNA comprises a 2'-O-(2-methoxy ethyl) (2'-O-moe) modified nucleotide. In some embodiments, the gRNA comprises a 2'-fluoro (2'-F) modified nucleotide. In some embodiments, the gRNA comprises a phosphorothioate (PS) bond between nucleotides. In some embodiments, the gRNA comprises a 5' end modification, a 3' end modification, or 5' and 3' end modifications. In some embodiments, the 5' end modification comprises a phosphorothioate (PS) bond between nucleotides. In some embodiments, the 5' end modification comprises a 2'-O-methyl (2'-O-Me), 2'-O-(2-methoxy ethyl) (2'-O-MOE), and/or 2'-fluoro (2'-F) modified nucleotide. In some embodiments, the 5' end modification comprises at least one phosphorothioate (PS) bond and one or more of a 2'-O-methyl (2'-O-Me), 2'-O-(2-methoxyethyl) (2'-O-MOE), and/or 2'-fluoro (2'-F) modified nucleotide. The end modification may comprise a phosphorothioate (PS), 2'-O-methyl (2'-O-Me), 2'-O-(2-methoxyethyl) (2'-O-MOE), and/or 2'-fluoro (2'-F) modification. Equivalent end modifications are also encompassed by embodiments described herein. In some embodiments, the template RNA or gRNA comprises an end modification in combination with a modification of one or more regions of the template RNA or gRNA. Additional exemplary modifications and methods for protecting RNA, e.g., gRNA, and formulae thereof, are described in WO2018126176A1, which is incorporated herein by reference in its entirety.

In some embodiments, structure-guided and systematic approaches are used to introduce modifications (e.g., 2'-OMe-RNA, 2'-F-RNA, and PS modifications) to a template RNA or guide RNA, for example, as described in Mir et al. *Nat Commun* 9:2641 (2018) (incorporated by reference herein in its entirety). In some embodiments, the incorporation of 2'-F-RNAs increases thermal and nuclease stability of RNA:RNA or RNA:DNA duplexes, e.g., while minimally interfering with C3'-endo sugar puckering. In some embodiments, 2'-F may be better tolerated than 2'-OMe at positions where the 2'-OH is important for RNA:DNA duplex stability. In some embodiments, a crRNA comprises one or more modifications that do not reduce Cas9 activity, e.g., C10, C20, or C21 (fully modified), e.g., as described in Supplementary Table 1 of Mir et al. *Nat Commun* 9:2641 (2018), incorporated herein by reference in its entirety. In some embodiments, a tracrRNA comprises one or more modifications that do not reduce Cas9 activity, e.g., T2, T6, T7, or T8 (fully modified) of Supplementary Table 1 of Mir et al. *Nat Commun* 9:2641 (2018). In some embodiments, a crRNA comprises one or more modifications (e.g., as described herein) may be paired with a tracrRNA comprising one or more modifications, e.g., C20 and T2. In some embodiments, a gRNA comprises a chimera, e.g., of a crRNA and a tracrRNA (e.g., Jinek et al. *Science* 337(6096): 816-821 (2012)). In embodiments, modifications from the crRNA and tracrRNA are mapped onto the single-guide chimera, e.g., to produce a modified gRNA with enhanced stability.

In some embodiments, gRNA molecules may be modified by the addition or subtraction of the naturally occurring structural components, e.g., hairpins. In some embodiments, a gRNA may comprise a gRNA with one or more 3' hairpin elements deleted, e.g., as described in WO2018106727, incorporated herein by reference in its entirety. In some embodiments, a gRNA may contain an added hairpin structure, e.g., an added hairpin structure in the spacer region, which was shown to increase specificity of a CRISPR-Cas system in the teachings of Kocak et al. *Nat Biotechnol* 37(6):657-666 (2019). Additional modifications, including examples of shortened gRNA and specific modifications improving in vivo activity, can be found in US20190316121, incorporated herein by reference in its entirety.

In some embodiments, structure-guided and systematic approaches (e.g., as described in Mir et al. *Nat Commun* 9:2641 (2018); incorporated herein by reference in its entirety) are employed to find modifications for the template RNA. In embodiments, the modifications are identified with the inclusion or exclusion of a guide region of the template RNA. In some embodiments, a structure of polypeptide bound to template RNA is used to determine non-protein-contacted nucleotides of the RNA that may then be selected for modifications, e.g., with lower risk of disrupting the association of the RNA with the polypeptide. Secondary structures in a template RNA can also be predicted in silico by software tools, e.g., the RNAstructure tool available at rna.urmc.rochester.edu/RNAstructureWeb (Bellaousov et al. *Nucleic Acids Res* 41:W471-W474 (2013); incorporated by reference herein in its entirety), e.g., to determine secondary structures for selecting modifications, e.g., hairpins, stems, and/or bulges.

Production of Compositions and Systems

As will be appreciated by one of skill, methods of designing and constructing nucleic acid constructs and proteins or polypeptides (such as the systems, constructs and polypeptides described herein) are routine in the art. Generally, recombinant methods may be used. See, in general, Smales & James (Eds.), *Therapeutic Proteins: Methods and Protocols* (Methods in Molecular Biology), Humana Press (2005); and Crommelin, Sindelar & Meibohm (Eds.), *Pharmaceutical Biotechnology: Fundamentals and Applications*, Springer (2013). Methods of designing, preparing, evaluating, purifying and manipulating nucleic acid compositions are described in Green and Sambrook (Eds.), *Molecular Cloning: A Laboratory Manual* (Fourth Edition), Cold Spring Harbor Laboratory Press (2012).

The disclosure provides, in part, a nucleic acid, e.g., vector, encoding a gene modifying polypeptide described herein, a template nucleic acid described herein, or both. In some embodiments, a vector comprises a selective marker, e.g., an antibiotic resistance marker. In some embodiments, the antibiotic resistance marker is a kanamycin resistance marker. In some embodiments, the antibiotic resistance marker does not confer resistance to beta-lactam antibiotics. In some embodiments, the vector does not comprise an ampicillin resistance marker. In some embodiments, the vector comprises a kanamycin resistance marker and does not comprise an ampicillin resistance marker. In some embodiments, a vector encoding a gene modifying polypeptide is integrated into a target cell genome (e.g., upon administration to a target cell, tissue, organ, or subject). In some embodiments, a vector encoding a gene modifying polypeptide is not integrated into a target cell genome (e.g., upon administration to a target cell, tissue, organ, or subject). In some embodiments, a vector encoding a template nucleic acid (e.g., template RNA) is not integrated into a target cell genome (e.g., upon administration to a target cell, tissue, organ, or subject). In some embodiments, if a vector is integrated into a target site in a target cell genome, the selective marker is not integrated into the genome. In some embodiments, if a vector is integrated into a target site in a target cell genome, genes or sequences involved in vector maintenance (e.g., plasmid maintenance genes) are not integrated into the genome. In some embodiments, if a vector is integrated into a target site in a target cell genome, transfer regulating sequences (e.g., inverted terminal repeats, e.g., from an AAV) are not integrated into the genome. In some embodiments, administration of a vector (e.g., encoding a gene modifying polypeptide described herein, a template nucleic acid described herein, or both) to a target cell, tissue, organ, or subject results in integration of a portion of the vector into one or more target sites in the genome(s) of said target cell, tissue, organ, or subject. In some embodiments, less than 99, 95, 90, 80, 70, 60, 50, 40, 30, 20, 10, 5, 4, 3, 2, or 1% of target sites (e.g., no target sites) comprising integrated material comprise a selective marker (e.g., an antibiotic resistance gene), a transfer regulating sequence (e.g., an inverted terminal repeat, e.g., from an AAV), or both from the vector.

Exemplary methods for producing a therapeutic pharmaceutical protein or polypeptide described herein involve expression in mammalian cells, although recombinant proteins can also be produced using insect cells, yeast, bacteria, or other cells under control of appropriate promoters. Mammalian expression vectors may comprise non-transcribed elements such as an origin of replication, a suitable promoter, and other 5' or 3' flanking non-transcribed sequences, and 5' or 3' non-translated sequences such as necessary ribosome binding sites, a polyadenylation site, splice donor and acceptor sites, and termination sequences. DNA sequences derived from the SV40 viral genome, for example, SV40 origin, early promoter, splice, and polyadenylation sites may be used to provide other genetic elements required for expression of a heterologous DNA sequence. Appropriate cloning and expression vectors for use with bacterial, fungal, yeast, and mammalian cellular hosts are described in Green & Sambrook, *Molecular Cloning: A Laboratory Manual* (Fourth Edition), Cold Spring Harbor Laboratory Press (2012).

Various mammalian cell culture systems can be employed to express and manufacture recombinant protein. Examples of mammalian expression systems include CHO, COS, HEK293, HeLA, and BHK cell lines. Processes of host cell culture for production of protein therapeutics are described in Zhou and Kantardjieff (Eds.), *Mammalian Cell Cultures for Biologics Manufacturing (Advances in Biochemical Engineering/Biotechnology)*, Springer (2014). Compositions described herein may include a vector, such as a viral vector, e.g., a lentiviral vector, encoding a recombinant protein. In some embodiments, a vector, e.g., a viral vector, may comprise a nucleic acid encoding a recombinant protein.

Purification of protein therapeutics is described in Franks, Protein Biotechnology: *Isolation, Characterization, and Stabilization*, Humana Press (2013); and in Cutler, *Protein Purification Protocols (Methods in Molecular Biology)*, Humana Press (2010).

The disclosure also provides compositions and methods for the production of template nucleic acid molecules (e.g., template RNAs) with specificity for a gene modifying polypeptide and/or a genomic target site. In an aspect, the method comprises production of RNA segments including an upstream homology segment, a heterologous object sequence segment, a gene modifying polypeptide binding motif, and a gRNA segment.

Therapeutic Applications

In some embodiments, a gene modifying system as described herein can be used to modify a cell (e.g., an animal cell, plant cell, or fungal cell). In some embodiments, a gene modifying system as described herein can be used to modify a mammalian cell (e.g., a human cell). In some embodiments, a gene modifying system as described herein can be used to modify a cell from a livestock animal (e.g., a cow, horse, sheep, goat, pig, llama, alpaca, camel, yak, chicken, duck, goose, or ostrich). In some embodiments, a gene modifying system as described herein can be used as a laboratory tool or a research tool, or used in a laboratory method or research method, e.g., to modify an animal cell, e.g., a mammalian cell (e.g., a human cell), a plant cell, or a fungal cell.

By integrating coding genes into a RNA sequence template, the gene modifying system can address therapeutic needs, for example, by providing expression of a therapeutic transgene in individuals with loss-of-function mutations, by replacing gain-of-function mutations with normal transgenes, by providing regulatory sequences to eliminate gain-of-function mutation expression, and/or by controlling the expression of operably linked genes, transgenes and systems thereof. In certain embodiments, the RNA sequence template encodes a promotor region specific to the therapeutic needs of the host cell, for example a tissue specific promotor or enhancer. In still other embodiments, a promotor can be operably linked to a coding sequence.

In some embodiments, an insertion, deletion, substitution, or combination thereof, increases or decreases expression (e.g. transcription or translation) of a target gene. In some embodiments, an insertion, deletion, substitution, or combination thereof, increases or decreases expression (e.g. transcription or translation) of a target gene by altering, adding, or deleting sequences in a promoter or enhancer, e.g. sequences that bind transcription factors. In some embodiments, an insertion, deletion, substitution, or combination thereof alters translation of a target gene (e.g. alters an amino acid sequence), inserts or deletes a start or stop codon, alters or fixes the translation frame of a gene. In some embodiments, an insertion, deletion, substitution, or combination thereof alters splicing of a target gene, e.g. by inserting, deleting, or altering a splice acceptor or donor site. In some embodiments, an insertion, deletion, substitution, or combination thereof alters transcript or protein half-life. In some embodiments, an insertion, deletion, substitution, or combination thereof, alters, increases, decreases the activity of a target gene, e.g. a protein encoded by the target gene.

Compensatory Edits

In some embodiments, the systems or methods provided herein can be used to introduce a compensatory edit. In some embodiments, the compensatory edit is at a position of a gene associated with a disease or disorder, which is different from the position of a disease-causing mutation. In some embodiments, the compensatory mutation is not in the gene containing the causative mutation. In some embodiments, the compensatory edit can negate or compensate for a disease-causing mutation. In some embodiments, the compensatory edit can be introduced by the systems or methods provided herein to suppress or reverse the mutant effect of a disease-causing mutation.

Regulatory Edits

In some embodiments, the systems or methods provided herein can be used to introduce a regulatory edit. In some embodiments, the regulatory edit is introduced to a regulatory sequence of a gene, for example, a gene promoter, gene enhancer, gene repressor, or a sequence that regulates gene splicing. In some embodiments, the regulatory edit increases or decreases the expression level of a target gene. In some embodiments, the target gene is the same as the gene containing a disease-causing mutation. In some embodiments, the target gene is different from the gene containing a disease-causing mutation.

Repeat Expansion Diseases

In some embodiments, the systems or methods provided herein can be used to treat a repeat expansion disease. In some embodiments, the systems or methods provided herein, for example, those comprising gene modifying polypeptides, can be used to treat repeat expansion diseases by resetting the number of repeats at the locus according to a customized RNA template.

Administration and Delivery

The compositions and systems described herein may be used in vitro or in vivo. In some embodiments the system or components of the system are delivered to cells (e.g., mammalian cells, e.g., human cells), e.g., in vitro or in vivo. In some embodiments, the cells are eukaryotic cells, e.g., cells of a multicellular organism, e.g., an animal, e.g., a mammal (e.g., human, swine, bovine), a bird (e.g., poultry, such as chicken, turkey, or duck), or a fish. In some embodiments, the cells are non-human animal cells (e.g., a laboratory animal, a livestock animal, or a companion animal). In some embodiments, the cell is a stem cell (e.g., a hematopoietic stem cell), a fibroblast, or a T cell. In some embodiments, the cell is an immune cell, e.g., a T cell (e.g., a Treg, CD4, CD8, γδ, or memory T cell), B cell (e.g., memory B cell or plasma cell), or NK cell. In some embodiments, the cell is a non-dividing cell, e.g., a non-dividing fibroblast or non-dividing T cell. In some embodiments, the cell is an HSC and p53 is not upregulated or is upregulated by less than 10%, 5%, 2%, or 1%, e.g., as determined according to the method described in Example 30 of PCT/US2019/048607. The skilled artisan will understand that the components of the gene modifying system may be delivered in the form of polypeptide, nucleic acid (e.g., DNA, RNA), and combinations thereof.

In one embodiment the system and/or components of the system are delivered as nucleic acid. For example, the gene modifying polypeptide may be delivered in the form of a DNA or RNA encoding the polypeptide, and the template RNA may be delivered in the form of RNA or its complementary DNA to be transcribed into RNA. In some embodiments the system or components of the system are delivered on 1, 2, 3, 4, or more distinct nucleic acid molecules. In some embodiments the system or components of the system are delivered as a combination of DNA and RNA. In some embodiments the system or components of the system are delivered as a combination of DNA and protein. In some embodiments the system or components of the system are delivered as a combination of RNA and protein. In some embodiments the gene modifying polypeptide is delivered as a protein.

In some embodiments the system or components of the system are delivered to cells, e.g. mammalian cells or human cells, using a vector. The vector may be, e.g., a plasmid or a virus. In some embodiments, delivery is in vivo, in vitro, ex vivo, or in situ. In some embodiments the virus is an adeno associated virus (AAV), a lentivirus, or an adenovirus. In some embodiments the system or components of the system are delivered to cells with a viral-like particle or a virosome. In some embodiments the delivery uses more than one virus, viral-like particle or virosome.

In one embodiment, the compositions and systems described herein can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

A variety of nanoparticles can be used for delivery, such as a liposome, a lipid nanoparticle, a cationic lipid nanoparticle, an ionizable lipid nanoparticle, a polymeric nanoparticle, a gold nanoparticle, a dendrimer, a cyclodextrin nanoparticle, a micelle, or a combination of the foregoing.

Lipid nanoparticles are an example of a carrier that provides a biocompatible and biodegradable delivery system for the pharmaceutical compositions described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi:10.3390/nano7060122.

Exosomes can also be used as drug delivery vehicles for the compositions and systems described herein. For a review, see Ha et al. July 2016. Acta Pharmaceutica Sinica B. Volume 6, Issue 4, Pages 287-296; doi.org/10.1016/j.apsb.2016.02.001.

Fusosomes interact and fuse with target cells, and thus can be used as delivery vehicles for a variety of molecules. They generally consist of a bilayer of amphipathic lipids enclosing a lumen or cavity and a fusogen that interacts with the amphipathic lipid bilayer. The fusogen component has been shown to be engineerable in order to confer target cell specificity for the fusion and payload delivery, allowing the creation of delivery vehicles with programmable cell specificity (see for example Patent Application WO2020014209, the teachings of which relating to fusosome design, preparation, and usage are incorporated herein by reference).

In some embodiments, the protein component(s) of the gene modifying system may be pre-associated with the template nucleic acid (e.g., template RNA). For example, in some embodiments, the gene modifying polypeptide may be first combined with the template nucleic acid (e.g., template RNA) to form a ribonucleoprotein (RNP) complex. In some embodiments, the RNP may be delivered to cells via, e.g., transfection, nucleofection, virus, vesicle, LNP, exosome, fusosome.

A gene modifying system can be introduced into cells, tissues and multicellular organisms. In some embodiments the system or components of the system are delivered to the cells via mechanical means or physical means.

Formulation of protein therapeutics is described in Meyer (Ed.), *Therapeutic Protein Drug Products: Practical Approaches toformulation in the Laboratory, Manufacturing, and the Clinic*, Woodhead Publishing Series (2012).

Tissue Specific Activity/Administration

In some embodiments, a system described herein can make use of one or more feature (e.g., a promoter or microRNA binding site) to limit activity in off-target cells or tissues.

In some embodiments, a nucleic acid described herein (e.g., a template RNA or a DNA encoding a template RNA) comprises a promoter sequence, e.g., a tissue specific promoter sequence. In some embodiments, the tissue-specific promoter is used to increase the target-cell specificity of a gene modifying system. For instance, the promoter can be chosen on the basis that it is active in a target cell type but not active in (or active at a lower level in) a non-target cell type. Thus, even if the promoter integrated into the genome of a non-target cell, it would not drive expression (or only drive low level expression) of an integrated gene. A system having a tissue-specific promoter sequence in the template RNA may also be used in combination with a microRNA binding site, e.g., in the template RNA or a nucleic acid encoding a gene modifying protein, e.g., as described herein. A system having a tissue-specific promoter sequence in the template RNA may also be used in combination with a DNA encoding a gene modifying polypeptide, driven by a tissue-specific promoter, e.g., to achieve higher levels of gene modifying protein in target cells than in non-target cells. In some embodiments, e.g., for liver indications, a tissue-specific promoter is selected from Table 3 of WO2020014209, incorporated herein by reference.

In some embodiments, a nucleic acid described herein (e.g., a template RNA or a DNA encoding a template RNA) comprises a microRNA binding site. In some embodiments, the microRNA binding site is used to increase the target-cell specificity of a gene modifying system. For instance, the microRNA binding site can be chosen on the basis that is recognized by a miRNA that is present in a non-target cell type, but that is not present (or is present at a reduced level relative to the non-target cell) in a target cell type. Thus, when the template RNA is present in a non-target cell, it would be bound by the miRNA, and when the template RNA is present in a target cell, it would not be bound by the miRNA (or bound but at reduced levels relative to the non-target cell). While not wishing to be bound by theory, binding of the miRNA to the template RNA may interfere with its activity, e.g., may interfere with insertion of the heterologous object sequence into the genome. Accordingly, the system would edit the genome of target cells more efficiently than it edits the genome of non-target cells, e.g., the heterologous object sequence would be inserted into the genome of target cells more efficiently than into the genome of non-target cells, or an insertion or deletion is produced more efficiently in target cells than in non-target cells. A system having a microRNA binding site in the template RNA (or DNA encoding it) may also be used in combination with a nucleic acid encoding a gene modifying polypeptide, wherein expression of the gene modifying polypeptide is regulated by a second microRNA binding site, e.g., as described herein. In some embodiments, e.g., for liver indications, a miRNA is selected from Table 4 of WO2020014209, incorporated herein by reference.

In some embodiments, the template RNA comprises a microRNA sequence, an siRNA sequence, a guide RNA sequence, or a piwi RNA sequence.

Promoters

In some embodiments, one or more promoter or enhancer elements are operably linked to a nucleic acid encoding a gene modifying protein or a template nucleic acid, e.g., that controls expression of the heterologous object sequence. In certain embodiments, the one or more promoter or enhancer elements comprise cell-type or tissue specific elements. In some embodiments, the promoter or enhancer is the same or derived from the promoter or enhancer that naturally controls expression of the heterologous object sequence. For example, the ornithine transcarbomylase promoter and enhancer may be used to control expression of the ornithine transcarbomylase gene in a system or method provided by the invention for correcting ornithine transcarbomylase deficiencies. In some embodiments, the promoter is a promoter of Table 16 or 17 or a functional fragment or variant thereof.

Exemplary tissue specific promoters that are commercially available can be found, for example, at a uniform resource locator (e.g., www.invivogen.com/tissue-specific-promoters). In some embodiments, a promoter is a native promoter or a minimal promoter, e.g., which consists of a single fragment from the 5' region of a given gene. In some embodiments, a native promoter comprises a core promoter and its natural 5' UTR. In some embodiments, the 5' UTR comprises an intron. In other embodiments, these include composite promoters, which combine promoter elements of different origins or were generated by assembling a distal enhancer with a minimal promoter of the same origin.

Exemplary cell or tissue specific promoters are provided in the tables, below, and exemplary nucleic acid sequences encoding them are known in the art and can be readily accessed using a variety of resources, such as the NCBI database, including RefSeq, as well as the Eukaryotic Promoter Database (//epd.epfl.ch//index.php).

TABLE 16

Exemplary cell or tissue-specific promoters

| Promoter | Target cells |
|---|---|
| B29 Promoter | B cells |
| CD14 Promoter | Monocytic Cells |
| CD43 Promoter | Leukocytes and platelets |
| CD45 Promoter | Hematopoeitic cells |
| CD68 promoter | macrophages |
| Desmin promoter | muscle cells |
| Elastase-1 promoter | pancreatic acinar cells |
| Endoglin promoter | endothelial cells |
| fibronectin promoter | differentiating cells, healing tissue |
| Flt-1 promoter | endothelial cells |
| GFAP promoter | Astrocytes |
| GPIIB promoter | megakaryocytes |
| ICAM-2 Promoter | Endothelial cells |
| INF-Beta promoter | Hematopoeitic cells |
| Mb promoter | muscle cells |
| Nphs1 promoter | podocytes |
| OG-2 promoter | Osteoblasts, Odonblasts |
| SP-B promoter | Lung |
| Syn1 promoter | Neurons |
| WASP promoter | Hematopoeitic cells |
| SV40/bAlb promoter | Liver |
| SV40/bAlb promoter | Liver |
| SV40/Cd3 promoter | Leukocytes and platelets |
| SV40/CD45 promoter | hematopoeitic cells |
| NSE/RU5' promoter | Mature Neurons |

TABLE 17

Additional exemplary cell or tissue-specific promoters

| Promoter | Gene Description | Gene Specificity |
|---|---|---|
| APOA2 | Apolipoprotein A-II | Hepatocytes (from hepatocyte progenitors) |
| SERPINA1 (hAAT) | Serpin peptidase inhibitor, clade A (alpha-1 antiproteinase, antitrypsin), member 1 (also named alpha 1 anti-tryps in) | Hepatocytes (from definitive endoderm stage) |
| CYP3A | Cytochrome P450, family 3, subfamily A, polypeptide | Mature Hepatocytes |
| MIR122 | MicroRNA 122 | Hepatocytes (from early stage embryonic liver cells) and endoderm |
| Pancreatic specific promoters ||| 
| INS | Insulin | Pancreatic beta cells (from definitive endoderm stage) |
| IRS2 | Insulin receptor substrate 2 | Pancreatic beta cells |
| Pdx1 | Pancreatic and duodenal homeobox 1 | Pancreas (from definitive endoderm stage) |
| Alx3 | Aristaless-like homeobox 3 | Pancreatic beta cells (from definitive endoderm stage) |
| Ppy | Pancreatic polypeptide | PP pancreatic cells (gamma cells) |
| Cardiac specific promoters ||| 
| Myh6 (aMHC) | Myosin, heavy chain 6, cardiac muscle, alpha | Late differentiation marker of cardiac muscle cells (atrial specificity) |
| MYL2 (MLC-2v) | Myosin, light chain 2, regulatory, cardiac, slow | Late differentiation marker of cardiac muscle cells (ventricular specificity) |
| ITNNI3 (cTnI) | Troponin I type 3 (cardiac) | Cardiomyocytes (from immature state) |
| ITNNI3 (cTnI) | Troponin I type 3 (cardiac) | Cardiomyocytes (from immature state) |
| NPPA (ANF) | Natriuretic peptide precursor A (also named Atrial Natriuretic Factor) | Atrial specificity in adult cells |
| Slc8a1 (Ncx1) | Solute carrier family 8 (sodium/calcium exchanger), member 1 | Cardiomyocytes from early developmental stages |
| CNS specific promoters ||| 
| SYN1 (hSyn) | Synapsin I | Neurons |
| GFAP | Glial fibrillary acidic protein | Astrocytes |
| INA | Internexin neuronal intermediate filament protein, alpha (a-internexin) | Neuroprogenitors |
| NES | Nestin | Neuroprogenitors and ectoderm |
| MOBP | Myelin-associated oligodendrocyte basic protein | Oligodendrocytes |
| MBP | Myelin basic protein | Oligodendrocytes |
| TH | Tyrosine hydroxylase | Dopaminergic neurons |
| FOXA2 (HNF3 beta) | Forkhead box A2 | Dopaminergic neurons (also used as a marker of endoderm) |
| Skin specific promoters ||| 
| FLG | Filaggrin | Keratinocytes from granular layer |
| K14 | Keratin 14 | Keratinocytes from granular and basal layers |
| TGM3 | Transglutaminase 3 | Keratinocytes from granular layer |
| Immune cell specific promoters ||| 
| ITGAM (CD11B) | Integrin, alpha M (complement component 3 receptor 3 subunit) | Monocytes, macrophages, granulocytes, natural killer cells |
| Urogential cell specific promoters ||| 
| Pbsn | Probasin | Prostatic epithelium |
| Upk2 | Uroplakin 2 | Bladder |
| Sbp | Spermine binding protein | Prostate |
| Fer1l4 | Fer-1-like 4 | Bladder |
| Endothelial cell specific promoters ||| 
| ENG | Endoglin | Endothelial cells |
| Pluripotent and embryonic cell specific promoters ||| 
| Oct4 (POU5F1) | POU class 5 homeobox 1 | Pluripotent cells (germ cells, ES cells, iPS cells) |
| NANOG | Nanog homeobox | Pluripotent cells (ES cells, iPS cells) |
| Synthetic Oct4 | Synthetic promoter based on a Oct-4 core enhancer element | Pluripotent cells (ES cells, iPS cells) |
| T brachyury | Brachyury | Mesoderm |
| NES | Nestin | Neuroprogenitors and Ectoderm |
| SOX17 | SRY (sex determining region Y)-box 17 | Endoderm |
| FOXA2 (HNFJ beta) | Forkhead box A2 | Endoderm (also used as a marker of dopaminergic neurons) |
| MIR122 | MicroRNA 122 | Endoderm and hepatocytes (from early stage embryonic liver cells~ |

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology*, 153:516-544; incorporated herein by reference in its entirety).

In some embodiments, a nucleic acid encoding a gene modifying protein or template nucleic acid is operably linked to a control element, e.g., a transcriptional control element, such as a promoter. The transcriptional control element may, in some embodiment, be functional in either a eukaryotic cell, e.g., a mammalian cell; or a prokaryotic cell (e.g., bacterial or archaeal cell). In some embodiments, a nucleotide sequence encoding a polypeptide is operably linked to multiple control elements, e.g., that allow expression of the nucleotide sequence encoding the polypeptide in both prokaryotic and eukaryotic cells.

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter, a neurofilament promoter (see, e.g., GenBank HUMNFL, L04147); a synapsin promoter (see, e.g., GenBank HUMSYNIB, M55301); a thy-1 promoter (see, e.g., Chen et al. (1987) Cell 51:7-19; and Llewellyn, et al. (2010) Nat. Med. 16(10):1161-1166); a serotonin receptor promoter (see, e.g., GenBank S62283); a tyrosine hydroxylase promoter (TH) (see, e.g., Oh et al. (2009) Gene Ther 16:437; Sasaoka et al. (1992) Mol. Brain Res. 16:274; Boundy et al. (1998) J. Neurosci. 18:9989; and Kaneda et al. (1991) Neuron 6:583-594); a GnRH promoter (see, e.g., Radovick et al. (1991) Proc. Natl. Acad. Sci. USA 88:3402-3406); an L7 promoter (see, e.g., Oberdick et al. (1990) Science 248:223-226); a DNMT promoter (see, e.g., Bartge et al. (1988) Proc. Natl. Acad. Sci. USA 85:3648-3652); an enkephalin promoter (see, e.g., Comb et al. (1988) EMBO J. 17:3793-3805); a myelin basic protein (MBP) promoter; a Ca2+-calmodulin-dependent protein kinase II-alpha (CamKIIα) promoter (see, e.g., Mayford et al. (1996) Proc. Natl. Acad. Sci. USA 93:13250; and Casanova et al. (2001) Genesis 31:37); a CMV enhancer/platelet-derived growth factor-β promoter (see, e.g., Liu et al. (2004) Gene Therapy 11:52-60); and the like.

Adipocyte-specific spatially restricted promoters include, but are not limited to, the aP2 gene promoter/enhancer, e.g., a region from −5.4 kb to +21 bp of a human aP2 gene (see, e.g., Tozzo et al. (1997) Endocrinol. 138:1604; Ross et al. (1990) Proc. Natl. Acad. Sci. USA 87:9590; and Pavjani et al. (2005) Nat. Med. 11:797); a glucose transporter-4 (GLUT4) promoter (see, e.g., Knight et al. (2003) Proc. Natl. Acad. Sci. USA 100:14725); a fatty acid translocase (FAT/CD36) promoter (see, e.g., Kuriki et al. (2002) Biol. Pharm. Bull. 25:1476; and Sato et al. (2002) J. Biol. Chem. 277:15703); a stearoyl-CoA desaturase-1 (SCD1) promoter (Tabor et al. (1999) J. Biol. Chem. 274:20603); a leptin promoter (see, e.g., Mason et al. (1998) Endocrinol. 139:1013; and Chen et al. (1999) Biochem. Biophys. Res. Comm. 262:187); an adiponectin promoter (see, e.g., Kita et al. (2005) Biochem. Biophys. Res. Comm. 331:484; and Chakrabarti (2010) Endocrinol. 151:2408); an adipsin promoter (see, e.g., Platt et al. (1989) Proc. Natl. Acad. Sci. USA 86:7490); a resistin promoter (see, e.g., Seo et al. (2003) Molec. Endocrinol. 17:1522); and the like.

Cardiomyocyte-specific spatially restricted promoters include, but are not limited to, control sequences derived from the following genes: myosin light chain-2, α-myosin heavy chain, AE3, cardiac troponin C, cardiac actin, and the like. Franz et al. (1997) Cardiovasc. Res. 35:560-566; Robbins et al. (1995) Ann. N.Y. Acad. Sci. 752:492-505; Linn et al. (1995) Circ. Res. 76:584-591; Parmacek et al. (1994) Mol. Cell. Biol. 14:1870-1885; Hunter et al. (1993) Hypertension 22:608-617; and Sartorelli et al. (1992) Proc. Natl. Acad. Sci. USA 89:4047-4051.

Smooth muscle-specific spatially restricted promoters include, but are not limited to, an SM22α promoter (see, e.g., Akyürek et al. (2000) Mol. Med. 6:983; and U.S. Pat. No. 7,169,874); a smoothelin promoter (see, e.g., WO 2001/018048); an a-smooth muscle actin promoter; and the like. For example, a 0.4 kb region of the SM22α promoter, within which lie two CArG elements, has been shown to mediate vascular smooth muscle cell-specific expression (see, e.g., Kim, et al. (1997) Mol. Cell. Biol. 17, 2266-2278; Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) Ophthalmol. Vis. Sci. 44:4076); a beta phosphodiesterase gene promoter (Nicoud et al. (2007) J. Gene Med. 9:1015); a retinitis pigmentosa gene promoter (Nicoud et al. (2007) supra); an interphotoreceptor retinoid-binding protein (IRBP) gene enhancer (Nicoud et al. (2007) supra); an IRBP gene promoter (Yokoyama et al. (1992) Exp Eye Res. 55:225); and the like.

In some embodiments, a gene modifying system, e.g., DNA encoding a gene modifying polypeptide, DNA encoding a template RNA, or DNA or RNA encoding a heterologous object sequence, is designed such that one or more elements is operably linked to a tissue-specific promoter, e.g., a promoter that is active in T-cells. In further embodiments, the T-cell active promoter is inactive in other cell types, e.g., B-cells, NK cells. In some embodiments, the T-cell active promoter is derived from a promoter for a gene encoding a component of the T-cell receptor, e.g., TRAC, TRBC, TRGC, TRDC. In some embodiments, the T-cell active promoter is derived from a promoter for a gene encoding a component of a T-cell-specific cluster of differentiation protein, e.g., CD3, e.g., CD3D, CD3E, CD3G, CD3Z. In some embodiments, T-cell-specific promoters in gene modifying systems are discovered by comparing publicly available gene expression data across cell types and selecting promoters from the genes with enhanced expression in T-cells. In some embodiments, promoters may be selecting depending on the desired expression breadth, e.g., promoters that are active in T-cells only, promoters that are active in NK cells only, promoters that are active in both T-cells and NK cells.

Cell-specific promoters known in the art may be used to direct expression of a gene modifying protein, e.g., as described herein. Nonlimiting exemplary mammalian cell-specific promoters have been characterized and used in mice expressing Cre recombinase in a cell-specific manner. Certain nonlimiting exemplary mammalian cell-specific promoters are listed in Table 1 of U.S. Pat. No. 9,845,481, incorporated herein by reference.

In some embodiments, a vector as described herein comprises an expression cassette. Typically, an expression cassette comprises the nucleic acid molecule of the instant invention operatively linked to a promoter sequence. For example, a promoter is operatively linked with a coding sequence when it is capable of affecting the expression of that coding sequence (e.g., the coding sequence is under the transcriptional control of the promoter). Encoding sequences can be operatively linked to regulatory sequences in sense or antisense orientation. In certain embodiments, the promoter is a heterologous promoter. In certain embodiments, an expression cassette may comprise additional elements, for example, an intron, an enhancer, a polyadenylation site, a woodchuck response element (WRE), and/or other elements known to affect expression levels of the encoding sequence. A promoter typically controls the expression of a coding sequence or functional RNA. In certain embodiments, a promoter sequence comprises proximal and more distal upstream elements and can further comprise an enhancer element. An enhancer can typically stimulate promoter activity and may be an innate element of the promoter or a heterologous element inserted to enhance the level or tissue-specificity of a promoter. In certain embodiments, the promoter is derived in its entirety from a native gene. In certain embodiments, the promoter is composed of different elements derived from different naturally occurring promoters. In certain embodiments, the promoter comprises a synthetic nucleotide sequence. It will be understood by those skilled in the art that different promoters will direct the expression of a gene in different tissues or cell types, or at different stages of development, or in response to different environmental conditions or to the presence or the absence of a drug or transcriptional co-factor. Ubiquitous, cell-type-specific, tissue-specific, developmental stage-specific, and conditional promoters, for example, drug-responsive promoters (e.g., tetracycline-responsive promoters) are well known to those of skill in the art. Exemplary promoters include, but are not limited to, the phosphoglycerate kinase (PKG) promoter, CAG (composite of the CMV enhancer the chicken beta actin promoter (CBA) and the rabbit beta globin intron), NSE (neuronal specific enolase), synapsin or NeuN promoters, the SV40 early promoter, mouse mammary tumor virus LTR promoter; adenovirus major late promoter (Ad MLP), a herpes simplex virus (HSV) promoter, a cytomegalovirus (CMV) promoter such as the CMV immediate early promoter region (CMVIE), SFFV promoter, rous sarcoma virus (RSV) promoter, synthetic promoters, hybrid promoters, and the like. Other promoters can be of human origin or from other species, including from mice. Common promoters include, e.g., the human cytomegalovirus (CMV) immediate early gene promoter, the SV40 early promoter, the Rous sarcoma virus long terminal repeat, [beta]-actin, rat insulin promoter, the phosphoglycerate kinase promoter, the human alpha-1 antitrypsin (hAAT) promoter, the transthyretin promoter, the TBG promoter and other liver-specific promoters, the desmin promoter and similar muscle-specific promoters, the EF1-alpha promoter, hybrid promoters with multi-tissue specificity, promoters specific for neurons like synapsin and glyceraldehyde-3-phosphate dehydrogenase promoter, all of which are promoters well known and readily available to those of skill in the art, can be used to obtain high-level expression of the coding sequence of interest. In addition, sequences derived from non-viral genes, such as the murine metallothionein gene, will also find use herein. Such promoter sequences are commercially available from, e.g., Stratagene (San Diego, CA). Additional exemplary promoter sequences are described, for example, in WO2018213786A1 (incorporated by reference herein in its entirety).

In some embodiments, the apolipoprotein E enhancer (ApoE) or a functional fragment thereof is used, e.g., to drive expression in the liver. In some embodiments, two copies of the ApoE enhancer or a functional fragment thereof are used. In some embodiments, the ApoE enhancer or functional fragment thereof is used in combination with a promoter, e.g., the human alpha-1 antitrypsin (hAAT) promoter.

In some embodiments, the regulatory sequences impart tissue-specific gene expression capabilities. In some cases, the tissue-specific regulatory sequences bind tissue-specific transcription factors that induce transcription in a tissue specific manner. Various tissue-specific regulatory sequences (e.g., promoters, enhancers, etc.) are known in the art. Exemplary tissue-specific regulatory sequences include, but are not limited to, the following tissue-specific promoters: a liver-specific thyroxin binding globulin (TBG) promoter, an insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promoter, a α-myosin heavy chain (a-MHC) promoter, or a cardiac Troponin T (cTnT) promoter. Other exemplary promoters include Beta-actin promoter, hepatitis B virus core promoter, Sandig et al., Gene Ther., 3:1002-9 (1996); alpha-fetoprotein (AFP) promoter, Arbuthnot et al., Hum. Gene Ther., 7:1503-14 (1996)), bone osteocalcin promoter (Stein et al., Mol. Biol. Rep., 24:185-96 (1997)); bone sialoprotein promoter (Chen et al., J. Bone Miner. Res., 11:654-64 (1996)), CD2 promoter (Hansal et al., J. Immunol., 161:1063-8 (1998); immunoglobulin heavy chain promoter; T cell receptor α-chain promoter, neuronal such as neuron-specific enolase (NSE) promoter (Andersen et al., Cell. Mol. Neurobiol., 13:503-15 (1993)), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), and others. Additional exemplary promoter sequences are described, for example, in U.S. patent Ser. No. 10/300,146 (incorporated herein by reference in its entirety). In some embodiments, a tissue-specific regulatory element, e.g., a tissue-specific promoter, is selected from one known to be operably linked to a gene that is highly expressed in a given tissue, e.g., as measured by RNA-seq or protein expression data, or a combination thereof. Methods for analyzing tissue specificity by expression are taught in Fagerberg et al. *Mol Cell Proteomics* 13(2):397-406 (2014), which is incorporated herein by reference in its entirety.

In some embodiments, a vector described herein is a multicistronic expression construct. Multicistronic expression constructs include, for example, constructs harboring a first expression cassette, e.g. comprising a first promoter and a first encoding nucleic acid sequence, and a second expression cassette, e.g. comprising a second promoter and a second encoding nucleic acid sequence. Such multicistronic expression constructs may, in some instances, be particularly useful in the delivery of non-translated gene products, such as hairpin RNAs, together with a polypeptide, for example, a gene modifying polypeptide and gene modifying template. In some embodiments, multicistronic expression constructs may exhibit reduced expression levels of one or more of the included transgenes, for example, because of promoter interference or the presence of incompatible nucleic acid elements in close proximity. If a multicistronic expression construct is part of a viral vector, the presence of a self-complementary nucleic acid sequence may, in some instances, interfere with the formation of structures necessary for viral reproduction or packaging.

In some embodiments, the sequence encodes an RNA with a hairpin. In some embodiments, the hairpin RNA is a guide RNA, a template RNA, a shRNA, or a microRNA. In some embodiments, the first promoter is an RNA polymerase I promoter. In some embodiments, the first promoter is an RNA polymerase II promoter. In some embodiments, the second promoter is an RNA polymerase III promoter. In some embodiments, the second promoter is a U6 or H1 promoter.

Without wishing to be bound by theory, multicistronic expression constructs may not achieve optimal expression levels as compared to expression systems containing only one cistron. One of the suggested causes of lower expression levels achieved with multicistronic expression constructs comprising two or more promoter elements is the phenomenon of promoter interference (see, e.g., Curtin J A, Dane A P, Swanson A, Alexander I E, Ginn S L. *Bidirectional promoter interference between two widely used internal heterologous promoters in a late-generation lentiviral construct.* Gene Ther. 2008 March; 15(5):384-90; and Martin-Duque P, Jezzard S, Kaftansis L, Vassaux G. *Direct comparison of the insulating properties of two genetic elements in an adenoviral vector containing two different expression cassettes.* Hum Gene Ther. 2004 October; 15(10):995-1002; both references incorporated herein by reference for disclosure of promoter interference phenomenon). In some embodiments, the problem of promoter interference may be overcome, e.g., by producing multicistronic expression constructs comprising only one promoter driving transcription of multiple encoding nucleic acid sequences separated by internal ribosomal entry sites, or by separating cistrons comprising their own promoter with transcriptional insulator elements. In some embodiments, single-promoter driven expression of multiple cistrons may result in uneven expression levels of the cistrons. In some embodiments, a promoter cannot efficiently be isolated and isolation elements may not be compatible with some gene transfer vectors, for example, some retroviral vectors.

MicroRNAs

MicroRNAs (miRNAs) and other small interfering nucleic acids generally regulate gene expression via target RNA transcript cleavage/degradation or translational repression of the target messenger RNA (mRNA). miRNAs may, in some instances, be natively expressed, typically as final 19-25 non-translated RNA products. miRNAs generally exhibit their activity through sequence-specific interactions with the 3' untranslated regions (UTR) of target mRNAs. These endogenously expressed miRNAs may form hairpin precursors that are subsequently processed into an miRNA duplex, and further into a mature single stranded miRNA molecule. This mature miRNA generally guides a multiprotein complex, miRISC, which identifies target 3' UTR regions of target mRNAs based upon their complementarity to the mature miRNA. Useful transgene products may include, for example, miRNAs or miRNA binding sites that regulate the expression of a linked polypeptide. A non-limiting list of miRNA genes; the products of these genes and their homologues are useful as transgenes or as targets for small interfering nucleic acids (e.g., miRNA sponges, antisense oligonucleotides), e.g., in methods such as those listed in U.S. Ser. No. 10/300,146, 22:25-25:48, are herein incorporated by reference. In some embodiments, one or more binding sites for one or more of the foregoing miRNAs are incorporated in a transgene, e.g., a transgene delivered by a rAAV vector, e.g., to inhibit the expression of the transgene in one or more tissues of an animal harboring the transgene. In some embodiments, a binding site may be selected to control the expression of a transgene in a tissue specific manner. For example, binding sites for the liver-specific miR-122 may be incorporated into a transgene to inhibit expression of that transgene in the liver. Additional exemplary miRNA sequences are described, for example, in U.S. Pat. No. 10,300,146 (incorporated herein by reference in its entirety).

An miR inhibitor or miRNA inhibitor is generally an agent that blocks miRNA expression and/or processing. Examples of such agents include, but are not limited to, microRNA antagonists, microRNA specific antisense, microRNA sponges, and microRNA oligonucleotides (double-stranded, hairpin, short oligonucleotides) that inhibit miRNA interaction with a Drosha complex. MicroRNA inhibitors, e.g., miRNA sponges, can be expressed in cells from transgenes (e.g., as described in Ebert, M. S. Nature Methods, Epub Aug. 12, 2007; incorporated by reference herein in its entirety). In some embodiments, microRNA sponges, or other miR inhibitors, are used with the AAVs. microRNA sponges generally specifically inhibit miRNAs through a complementary heptameric seed sequence. In some embodiments, an entire family of miRNAs can be silenced using a single sponge sequence. Other methods for silencing miRNA function (derepression of miRNA targets) in cells will be apparent to one of ordinary skill in the art.

In some embodiments, a gene modifying system, template RNA, or polypeptide described herein is administered to or is active in (e.g., is more active in) a target tissue, e.g., a first tissue. In some embodiments, the gene modifying system, template RNA, or polypeptide is not administered to or is less active in (e.g., not active in) a non-target tissue. In some embodiments, a gene modifying system, template RNA, or polypeptide described herein is useful for modifying DNA in a target tissue, e.g., a first tissue, (e.g., and not modifying DNA in a non-target tissue).

In some embodiments, a gene modifying system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, the nucleic acid in (b) comprises RNA.

In some embodiments, the nucleic acid in (b) comprises DNA.

In some embodiments, the nucleic acid in (b): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (b) is double-stranded or comprises a double-stranded segment.

In some embodiments, (a) comprises a nucleic acid encoding the polypeptide.

In some embodiments, the nucleic acid in (a) comprises RNA.

In some embodiments, the nucleic acid in (a) comprises DNA.

In some embodiments, the nucleic acid in (a): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (a) is double-stranded or comprises a double-stranded segment.

In some embodiments, the nucleic acid in (a), (b), or (a) and (b) is linear.

In some embodiments, the nucleic acid in (a), (b), or (a) and (b) is circular, e.g., a plasmid or minicircle.

In some embodiments, the heterologous object sequence is in operative association with a first promoter.

In some embodiments, the one or more first tissue-specific expression-control sequences comprises a tissue specific promoter.

In some embodiments, the tissue-specific promoter comprises a first promoter in operative association with: (i) the heterologous object sequence, (ii) a nucleic acid encoding the retroviral RT, or (iii) (i) and (ii).

In some embodiments, the one or more first tissue-specific expression-control sequences comprises a tissue-specific microRNA recognition sequence in operative association with: (i) the heterologous object sequence, (ii) a nucleic acid encoding the retroviral RT domain, or (iii) (i) and (ii).

In some embodiments, a system comprises a tissue-specific promoter, and the system further comprises one or more tissue-specific microRNA recognition sequences, wherein: (i) the tissue specific promoter is in operative association with: (I) the heterologous object sequence, (II) a nucleic acid encoding the retroviral RT domain, or (III) (I) and (II); and/or (ii) the one or more tissue-specific microRNA recognition sequences are in operative association with: (I) the heterologous object sequence, (II) a nucleic acid encoding the retroviral RT, or (III) (I) and (II).

In some embodiments, wherein (a) comprises a nucleic acid encoding the polypeptide, the nucleic acid comprises a promoter in operative association with the nucleic acid encoding the polypeptide.

In some embodiments, the nucleic acid encoding the polypeptide comprises one or more second tissue-specific expression-control sequences specific to the target tissue in operative association with the polypeptide coding sequence.

In some embodiments, the one or more second tissue-specific expression-control sequences comprises a tissue specific promoter.

In some embodiments, the tissue-specific promoter is the promoter in operative association with the nucleic acid encoding the polypeptide.

In some embodiments, the one or more second tissue-specific expression-control sequences comprises a tissue-specific microRNA recognition sequence.

In some embodiments, the promoter in operative association with the nucleic acid encoding the polypeptide is a tissue-specific promoter, the system further comprising one or more tissue-specific microRNA recognition sequences.

In some embodiments, a nucleic acid component of a system provided by the invention is a sequence (e.g., encoding the polypeptide or comprising a heterologous object sequence) flanked by untranslated regions (UTRs) that modify protein expression levels. Various 5' and 3' UTRs can affect protein expression. For example, in some embodiments, the coding sequence may be preceded by a 5' UTR that modifies RNA stability or protein translation. In some embodiments, the sequence may be followed by a 3' UTR that modifies RNA stability or translation. In some embodiments, the sequence may be preceded by a 5' UTR and followed by a 3' UTR that modify RNA stability or translation. In some embodiments, the 5' and/or 3' UTR may be selected from the 5' and 3' UTRs of complement factor 3 (C3) (CACTCCTCCC-CATCCTCTCCCTCTGTCCCTCTGTCCCTCTGACCC TGCACTGTCCCAGCACC; SEQ ID NO: 11,004) or orosomucoid 1 (ORM1) (CAGGACACAGCCTTG-GATCAGGACAGAGACTTGGGGGC-CATCCTGCCCCTCCAACCCGACA TGTGTACCTCAGCTTTTTCCCTCACTTGCAT-CAATAAAGCTTCTGTGTTTGGAACAGCTAA; SEQ ID NO: 11,005) (Asrani et al. RNA Biology 2018). In certain embodiments, the 5' UTR is the 5' UTR from C3 and the 3' UTR is the 3' UTR from ORM1. In certain embodiments, a 5' UTR and 3' UTR for protein expression, e.g., mRNA (or DNA encoding the RNA) for a gene modifying polypeptide or heterologous object sequence, comprise optimized expression sequences. In some embodiments, the 5' UTR comprises GGGAAAUAAGAGAGAAAAGAAGAGUAAGAAGA AAUAUAAGAGCCACC (SEQ ID NO: 11,006) and/or the 3' UTR comprising (SEQ ID NO: 11,007)
UGAUAAUAGGCUGGAGCCUCGGUGGCCAUGCUUCUUGCCCCUUGGGCCU
CCCCCCAGCCCCUCCUCCCCUUCCUGCACCCGUACCCCCGUGGUCUUUG
AAUAAAGUCUGA, e.g., as described in Richner et al. Cell 168(6): P1114-1125 (2017), the sequences of which are incorporated herein by reference.

In some embodiments, a 5' and/or 3' UTR may be selected to enhance protein expression. In some embodiments, a 5' and/or 3' UTR may be selected to modify protein expression such that overproduction inhibition is minimized. In some embodiments, UTRs are around a coding sequence, e.g., outside the coding sequence and in other embodiments proximal to the coding sequence. In some embodiments, additional regulatory elements (e.g., miRNA binding sites, cis-regulatory sites) are included in the UTRs.

In some embodiments, an open reading frame of a gene modifying system, e.g., an ORF of an mRNA (or DNA encoding an mRNA) encoding a gene modifying polypeptide or one or more ORFs of an mRNA (or DNA encoding an mRNA) of a heterologous object sequence, is flanked by a 5' and/or 3' untranslated region (UTR) that enhances the expression thereof. In some embodiments, the 5' UTR of an mRNA component (or transcript produced from a DNA component) of the system comprises the sequence 5'-GG-GAAAUAAGAGAGAAAAGAAGAGUAAGAAGAAA UAUAAGAGCCACC-3'; SEQ ID NO: 11,008). In some embodiments, the 3' UTR of an mRNA component (or transcript produced from a DNA component) of the system comprises the sequence 5'-UGAUAAUAGGCUGGAGC-CUCGGUGGCCAUGCUUCUUGCCCCUUGGGC-CUCCCCCCAGCCC CUCCUCCCCUUC-CUGCACCCGUACCCCCGUGGUCUUUGAAUAAAGU-CUGA-3' (SEQ ID NO: 11,009). This combination of 5' UTR and 3' UTR has been shown to result in desirable expression of an operably linked ORF by Richner et al. Cell 168(6): P1114-1125 (2017), the teachings and sequences of which are incorporated herein by reference. In some embodiments, a system described herein comprises a DNA encoding a transcript, wherein the DNA comprises the corresponding 5' UTR and 3' UTR sequences, with T substituting for U in the above-listed sequence). In some embodiments, a DNA vector used to produce an RNA component of the system further comprises a promoter upstream of the 5' UTR for initiating in vitro transcription, e.g, a T7, T3, or SP6 promoter. The 5' UTR above begins with GGG, which is a suitable start for optimizing transcription using T7 RNA polymerase. For tuning transcription levels and altering the transcription start site nucleotides to fit alternative 5' UTRs, the teachings of Davidson et al. *Pac Symp Biocomput* 433-443 (2010) describe T7 promoter variants, and the methods of discovery thereof, that fulfill both of these traits.

Viral Vectors and Components Thereof

Viruses are a useful source of delivery vehicles for the systems described herein, in addition to a source of relevant enzymes or domains as described herein, e.g., as sources of polymerases and polymerase functions used herein, e.g., DNA-dependent DNA polymerase, RNA-dependent RNA polymerase, RNA-dependent DNA polymerase, DNA-dependent RNA polymerase, reverse transcriptase. Some enzymes, e.g., reverse transcriptases, may have multiple activities, e.g., be capable of both RNA-dependent DNA polymerization and DNA-dependent DNA polymerization, e.g., first and second strand synthesis. In some embodiments, the virus used as a gene modifying delivery system or a source of components thereof may be selected from a group as described by Baltimore *Bacteriol Rev* 35(3):235-241 (1971).

In some embodiments, the virus is selected from a Group I virus, e.g., is a DNA virus and packages dsDNA into virions. In some embodiments, the Group I virus is selected from, e.g., Adenoviruses, Herpesviruses, Poxviruses.

In some embodiments, the virus is selected from a Group II virus, e.g., is a DNA virus and packages ssDNA into virions. In some embodiments, the Group II virus is selected from, e.g., Parvoviruses. In some embodiments, the parvovirus is a dependoparvovirus, e.g., an adeno-associated virus (AAV).

In some embodiments, the virus is selected from a Group III virus, e.g., is an RNA virus and packages dsRNA into virions. In some embodiments, the Group III virus is selected from, e.g., Reoviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group IV virus, e.g., is an RNA virus and packages ssRNA(+) into virions. In some embodiments, the Group IV virus is selected from, e.g., Coronaviruses, Picornaviruses, Togaviruses. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group V virus, e.g., is an RNA virus and packages ssRNA(−) into virions. In some embodiments, the Group V virus is selected from, e.g., Orthomyxoviruses, Rhabdoviruses. In some embodiments, an RNA virus with an ssRNA(−) genome also carries an enzyme inside the virion that is transduced to host cells with the viral genome, e.g., an RNA-dependent RNA polymerase, capable of copying the ssRNA(−) into ssRNA(+) that can be translated directly by the host.

In some embodiments, the virus is selected from a Group VI virus, e.g., is a retrovirus and packages ssRNA(+) into virions. In some embodiments, the Group VI virus is selected from, e.g., retroviruses. In some embodiments, the retrovirus is a lentivirus, e.g., HIV-1, HIV-2, SIV, BIV. In some embodiments, the retrovirus is a spumavirus, e.g., a foamy virus, e.g., HFV, SFV, BFV. In some embodiments, the ssRNA(+) contained in such virions is a coding molecule able to serve directly as mRNA upon transduction into a host cell, e.g., can be directly translated into protein upon transduction into a host cell without requiring any intervening nucleic acid replication or polymerization steps. In some embodiments, the ssRNA(+) is first reverse transcribed and copied to generate a dsDNA genome intermediate from which mRNA can be transcribed in the host cell. In some embodiments, an RNA virus with an ssRNA(+) genome also carries an enzyme inside the virion that is transduced to host cells with the viral genome, e.g., an RNA-dependent DNA polymerase, capable of copying the ssRNA(+) into dsDNA that can be transcribed into mRNA and translated by the host. In some embodiments, the reverse transcriptase from a Group VI retrovirus is incorporated as the reverse transcriptase domain of a gene modifying polypeptide.

In some embodiments, the virus is selected from a Group VII virus, e.g., is a retrovirus and packages dsRNA into virions. In some embodiments, the Group VII virus is selected from, e.g., Hepadnaviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps. In some embodiments, one or both strands of the dsRNA contained in such virions is first reverse transcribed and copied to generate a dsDNA genome intermediate from which mRNA can be transcribed in the host cell. In some embodiments, an RNA virus with a dsRNA genome also carries an enzyme inside the virion that is transduced to host cells with the viral genome, e.g., an RNA-dependent DNA polymerase, capable of copying the dsRNA into dsDNA that can be transcribed into mRNA and translated by the host. In some embodiments, the reverse transcriptase from a Group VII retrovirus is incorporated as the reverse transcriptase domain of a gene modifying polypeptide.

In some embodiments, virions used to deliver nucleic acid in this invention may also carry enzymes involved in the process of gene modification. For example, a retroviral virion may contain a reverse transcriptase domain that is delivered into a host cell along with the nucleic acid. In some embodiments, an RNA template may be associated with a gene modifying polypeptide within a virion, such that both are co-delivered to a target cell upon transduction of the nucleic acid from the viral particle. In some embodiments, the nucleic acid in a virion may comprise DNA, e.g., linear ssDNA, linear dsDNA, circular ssDNA, circular dsDNA, minicircle DNA, dbDNA, ceDNA. In some embodiments, the nucleic acid in a virion may comprise RNA, e.g., linear ssRNA, linear dsRNA, circular ssRNA, circular dsRNA. In some embodiments, a viral genome may circularize upon transduction into a host cell, e.g., a linear ssRNA molecule may undergo a covalent linkage to form a circular ssRNA, a linear dsRNA molecule may undergo a covalent linkage to form a circular dsRNA or one or more circular ssRNA. In some embodiments, a viral genome may replicate by rolling circle replication in a host cell. In some embodiments, a viral genome may comprise a single nucleic acid molecule, e.g., comprise a non-segmented genome. In some embodiments, a viral genome may comprise two or more nucleic acid molecules, e.g., comprise a segmented genome. In some embodiments, a nucleic acid in a virion may be associated with one or proteins. In some embodiments, one or more proteins in a virion may be delivered to a host cell upon transduction. In some embodiments, a natural virus may be adapted for nucleic acid delivery by the addition of virion packaging signals to the target nucleic acid, wherein a host cell is used to package the target nucleic acid containing the packaging signals.

In some embodiments, a virion used as a delivery vehicle may comprise a commensal human virus. In some embodiments, a virion used as a delivery vehicle may comprise an anellovirus, the use of which is described in WO2018232017A1, which is incorporated herein by reference in its entirety.

AAV Administration

In some embodiments, an adeno-associated virus (AAV) is used in conjunction with the system, template nucleic acid, and/or polypeptide described herein. In some embodiments, an AAV is used to deliver, administer, or package the system, template nucleic acid, and/or polypeptide described herein. In some embodiments, the AAV is a recombinant AAV (rAAV).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, a system described herein further comprises a first recombinant adeno-associated virus (rAAV) capsid protein; wherein the at least one of (a) or (b) is associated with the first rAAV capsid protein, wherein at least one of (a) or (b) is flanked by AAV inverted terminal repeats (ITRs).

In some embodiments, (a) and (b) are associated with the first rAAV capsid protein.

In some embodiments, (a) and (b) are on a single nucleic acid.

In some embodiments, the system further comprises a second rAAV capsid protein, wherein at least one of (a) or (b) is associated with the second rAAV capsid protein, and wherein the at least one of (a) or (b) associated with the second rAAV capsid protein is different from the at least one of (a) or (b) is associated with the first rAAV capsid protein.

In some embodiments, the at least one of (a) or (b) is associated with the first or second rAAV capsid protein is dispersed in the interior of the first or second rAAV capsid protein, which first or second rAAV capsid protein is in the form of an AAV capsid particle.

In some embodiments, the system further comprises a nanoparticle, wherein the nanoparticle is associated with at least one of (a) or (b).

In some embodiments, (a) and (b), respectively are associated with: a) a first rAAV capsid protein and a second rAAV capsid protein; b) a nanoparticle and a first rAAV capsid protein; c) a first rAAV capsid protein; d) a first adenovirus capsid protein; e) a first nanoparticle and a second nanoparticle; or f) a first nanoparticle.

Viral vectors are useful for delivering all or part of a system provided by the invention, e.g., for use in methods provided by the invention. Systems derived from different viruses have been employed for the delivery of polypeptides or nucleic acids; for example: integrase-deficient lentivirus, adenovirus, adeno-associated virus (AAV), herpes simplex virus, and baculovirus (reviewed in Hodge et al. Hum Gene Ther 2017; Narayanavari et al. Crit Rev Biochem Mol Biol 2017; Boehme et al. Curr Gene Ther 2015).

Adenoviruses are common viruses that have been used as gene delivery vehicles given well-defined biology, genetic stability, high transduction efficiency, and ease of large-scale production (see, for example, review by Lee et al. Genes & Diseases 2017). They possess linear dsDNA genomes and come in a variety of serotypes that differ in tissue and cell tropisms. In order to prevent replication of infectious virus in recipient cells, adenovirus genomes used for packaging are deleted of some or all endogenous viral proteins, which are provided in trans in viral production cells. This renders the genomes helper-dependent, meaning they can only be replicated and packaged into viral particles in the presence of the missing components provided by so-called helper functions. A helper-dependent adenovirus system with all viral ORFs removed may be compatible with packaging foreign DNA of up to ~37 kb (Parks et al. J Virol 1997). In some embodiments, an adenoviral vector is used to deliver DNA corresponding to the polypeptide or template component of the gene modifying system, or both are contained on separate or the same adenoviral vector. In some embodiments, the adenovirus is a helper-dependent adenovirus (HD-AdV) that is incapable of self-packaging. In some embodiments, the adenovirus is a high-capacity adenovirus (HC-AdV) that has had all or a substantial portion of endogenous viral ORFs deleted, while retaining the necessary sequence components for packaging into adenoviral particles. For this type of vector, the only adenoviral sequences required for genome packaging are noncoding sequences: the inverted terminal repeats (ITRs) at both ends and the packaging signal at the 5'-end (Jager et al. Nat Protoc 2009). In some embodiments, the adenoviral genome also comprises stuffer DNA to meet a minimal genome size for optimal production and stability (see, for example, Hausl et al. Mol Ther 2010). In some embodiments, an adenovirus is used to deliver a gene modifying system to the liver.

In some embodiments, an adenovirus is used to deliver a gene modifying system to HSCs, e.g., HDAd5/35++. HDAd5/35++ is an adenovirus with modified serotype 35 fibers that de-target the vector from the liver (Wang et al. Blood Adv 2019). In some embodiments, the adenovirus that delivers a gene modifying system to HSCs utilizes a receptor that is expressed specifically on primitive HSCs, e.g., CD46.

Adeno-associated viruses (AAV) belong to the parvoviridae family and more specifically constitute the dependoparvovirus genus. The AAV genome is composed of a linear single-stranded DNA molecule which contains approximately 4.7 kilobases (kb) and consists of two major open reading frames (ORFs) encoding the non-structural Rep (replication) and structural Cap (capsid) proteins. A second ORF within the cap gene was identified that encodes the assembly-activating protein (AAP). The DNAs flanking the AAV coding regions are two cis-acting inverted terminal repeat (ITR) sequences, approximately 145 nucleotides in length, with interrupted palindromic sequences that can be folded into energetically stable hairpin structures that function as primers of DNA replication. In addition to their role in DNA replication, the ITR sequences have been shown to be involved in viral DNA integration into the cellular genome, rescue from the host genome or plasmid, and encapsidation of viral nucleic acid into mature virions (Muzyczka, (1992) Curr. Top. Micro. Immunol. 158:97-129). In some embodiments, one or more gene modifying nucleic acid components is flanked by ITRs derived from AAV for viral packaging. See, e.g., WO2019113310.

In some embodiments, one or more components of the gene modifying system are carried via at least one AAV vector. In some embodiments, the at least one AAV vector is selected for tropism to a particular cell, tissue, organism. In some embodiments, the AAV vector is pseudotyped, e.g., AAV2/8, wherein AAV2 describes the design of the construct but the capsid protein is replaced by that from AAV8. It is understood that any of the described vectors could be pseudotype derivatives, wherein the capsid protein used to package the AAV genome is derived from that of a different AAV serotype. Without wishing to be limited in vector choice, a list of exemplary AAV serotypes can be found in Table 18. In some embodiments, an AAV to be employed for gene modifying may be evolved for novel cell or tissue tropism as has been demonstrated in the literature (e.g., Davidsson et al. Proc Natl Acad Sci USA 2019).

In some embodiments, the AAV delivery vector is a vector which has two AAV inverted terminal repeats (ITRs) and a nucleotide sequence of interest (for example, a sequence coding for a gene modifying polypeptideor a DNA template, or both), each of said ITRs having an interrupted (or noncontiguous) palindromic sequence, i.e., a sequence composed of three segments: a first segment and a last segment that are identical when read 5'→3' but hybridize when placed against each other, and a segment that is different that separates the identical segments. See, for example, WO2012123430.

Conventionally, AAV virions with capsids are produced by introducing a plasmid or plasmids encoding the rAAV or scAAV genome, Rep proteins, and Cap proteins (Grimm et al, 1998). Upon introduction of these helper plasmids in trans, the AAV genome is "rescued" (i.e., released and subsequently recovered) from the host genome, and is further encapsidated to produce infectious AAV. In some embodiments, one or more gene modifying nucleic acids are packaged into AAV particles by introducing the ITR-flanked nucleic acids into a packaging cell in conjunction with the helper functions.

In some embodiments, the AAV genome is a so called self-complementary genome (referred to as scAAV), such that the sequence located between the ITRs contains both the desired nucleic acid sequence (e.g., DNA encoding the gene modifying polypeptide or template, or both) in addition to the reverse complement of the desired nucleic acid sequence, such that these two components can fold over and self-hybridize. In some embodiments, the self-complementary modules are separated by an intervening sequence that permits the DNA to fold back on itself, e.g., forms a stem-loop. An scAAV has the advantage of being poised for transcription upon entering the nucleus, rather than being first dependent on ITR priming and second-strand synthesis to form dsDNA. In some embodiments, one or more gene modifying components is designed as an scAAV, wherein the sequence between the AAV ITRs contains two reverse complementing modules that can self-hybridize to create dsDNA.

In some embodiments, nucleic acid (e.g., encoding a polypeptide, or a template, or both) delivered to cells is closed-ended, linear duplex DNA (CELiD DNA or ceDNA). In some embodiments, ceDNA is derived from the replicative form of the AAV genome (Li et al. PLoS One 2013). In some embodiments, the nucleic acid (e.g., encoding a polypeptide, or a template DNA, or both) is flanked by ITRs, e.g., AAV ITRs, wherein at least one of the ITRs comprises a terminal resolution site and a replication protein binding site (sometimes referred to as a replicative protein binding site). In some embodiments, the ITRs are derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, the ITRs are symmetric. In some embodiments, the ITRs are asymmetric. In some embodiments, at least one Rep protein is provided to enable replication of the construct. In some embodiments, the at least one Rep protein is derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, ceDNA is generated by providing a production cell with (i) DNA flanked by ITRs, e.g., AAV ITRs, and (ii) components required for ITR-dependent replication, e.g., AAV proteins Rep78 and Rep52 (or nucleic acid encoding the proteins). In some embodiments, ceDNA is free of any capsid protein, e.g., is not packaged into an infectious AAV particle. In some embodiments, ceDNA is formulated into LNPs (see, for example, WO2019051289A1).

In some embodiments, the ceDNA vector consists of two self-complementary sequences, e.g., asymmetrical or symmetrical or substantially symmetrical ITRs as defined herein, flanking said expression cassette, wherein the ceDNA vector is not associated with a capsid protein. In some embodiments, the ceDNA vector comprises two self-complementary sequences found in an AAV genome, where at least one ITR comprises an operative Rep-binding element (RBE) (also sometimes referred to herein as "RBS") and a terminal resolution site (trs) of AAV or a functional variant of the RBE. See, for example, WO2019113310.

In some embodiments, the AAV genome comprises two genes that encode four replication proteins and three capsid proteins, respectively. In some embodiments, the genes are flanked on either side by 145-bp inverted terminal repeats (ITRs). In some embodiments, the virion comprises up to three capsid proteins (Vp1, Vp2, and/or Vp3), e.g., produced in a 1:1:10 ratio. In some embodiments, the capsid proteins are produced from the same open reading frame and/or from differential splicing (Vp1) and alternative translational start sites (Vp2 and Vp3, respectively). Generally, Vp3 is the most abundant subunit in the virion and participates in receptor recognition at the cell surface defining the tropism of the virus. In some embodiments, Vp1 comprises a phospholipase domain, e.g., which functions in viral infectivity, in the N-terminus of Vp1.

In some embodiments, packaging capacity of the viral vectors limits the size of the gene modifying system that can be packaged into the vector. For example, the packaging capacity of the AAVs can be about 4.5 kb (e.g., about 3.0, 3.5, 4.0, 4.5, 5.0, 5.5, or 6.0 kb), e.g., including one or two inverted terminal repeats (ITRs), e.g., 145 base ITRs.

In some embodiments, recombinant AAV (rAAV) comprises cis-acting 145-bp ITRs flanking vector transgene cassettes, e.g., providing up to 4.5 kb for packaging of foreign DNA. Subsequent to infection, rAAV can, in some instances, express a fusion protein of the invention and persist without integration into the host genome by existing episomally in circular head-to-tail concatemers. rAAV can be used, for example, in vitro and in vivo. In some embodiments, AAV-mediated gene delivery requires that the length of the coding sequence of the gene is equal or greater in size than the wild-type AAV genome.

AAV delivery of genes that exceed this size and/or the use of large physiological regulatory elements can be accomplished, for example, by dividing the protein(s) to be delivered into two or more fragments. In some embodiments, the N-terminal fragment is fused to an intein-N sequence. In some embodiments, the C-terminal fragment is fused to an intein-C sequence. In embodiments, the fragments are packaged into two or more AAV vectors.

In some embodiments, dual AAV vectors are generated by splitting a large transgene expression cassette in two separate halves (5' and 3' ends, or head and tail), e.g., wherein each half of the cassette is packaged in a single AAV vector (of <5 kb). The re-assembly of the full-length transgene expression cassette can, in some embodiments, then be achieved upon co-infection of the same cell by both dual AAV vectors. In some embodiments, co-infection is followed by one or more of: (1) homologous recombination (H-R) between 5' and 3' genomes (dual AAV overlapping vectors); (2) ITR-mediated tail-to-head concatemerization of 5' and 3' genomes (dual AAV trans-splicing vectors); and/or (3) a combination of these two mechanisms (dual AAV hybrid vectors). In some embodiments, the use of dual AAV vectors in vivo results in the expression of full-length proteins. In some embodiments, the use of the dual AAV vector platform represents an efficient and viable gene transfer strategy for transgenes of greater than about 4.0, 4.1, 4.2, 4.3, 4.4, 4.5, 4.6, 4.7, 4.8, 4.9, or 5.0 kb in size. In some embodiments, AAV vectors can also be used to transduce cells with target nucleic acids, e.g., in the in vitro production of nucleic acids and peptides. In some embodiments, AAV vectors can be used for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994); each of which is incorporated herein by reference in their entirety). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989) (incorporated by reference herein in their entirety).

In some embodiments, a gene modifying polypeptide described herein (e.g., with or without one or more guide nucleic acids) can be delivered using AAV, lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as described in U.S. Pat. No. 8,454,972 and as in clinical trials involving AAV. For adenovirus, the route of administration, formulation and dose can be as described in U.S. Pat. No. 8,404,658 and as in clinical trials involving adenovirus. For plasmid delivery, the route of administration, formulation and dose can be as described in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. In some embodiments, the viral vectors can be injected into the tissue of interest. For cell-type specific gene modifying, the expression of the gene modifying polypeptide and optional guide nucleic acid can, in some embodiments, be driven by a cell-type specific promoter.

In some embodiments, AAV allows for low toxicity, for example, due to the purification method not requiring ultracentrifugation of cell particles that can activate the immune response. In some embodiments, AAV allows low probability of causing insertional mutagenesis, for example, because it does not substantially integrate into the host genome.

In some embodiments, AAV has a packaging limit of about 4.4, 4.5, 4.6, 4.7, or 4.75 kb. In some embodiments, a gene modifying polypeptide-encoding sequence, promoter, and transcription terminator can fit into a single viral vector. SpCas9 (4.1 kb) may, in some instances, be difficult to package into AAV. Therefore, in some embodiments, a gene modifying polypeptide coding sequence is used that is shorter in length than other gene modifying polypeptide coding sequences or base editors. In some embodiments, the gene modifying polypeptide encoding sequences are less than about 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb.

An AAV can be AAV1, AAV2, AAV5 or any combination thereof. In some embodiments, the type of AAV is selected with respect to the cells to be targeted; e.g., AAV serotypes 1, 2, 5 or a hybrid capsid AAV1, AAV2, AAV5 or any combination thereof can be selected for targeting brain or neuronal cells; or AAV4 can be selected for targeting cardiac tissue. In some embodiments, AAV8 is selected for delivery to the liver. Exemplary AAV serotypes as to these cells are described, for example, in Grimm, D. et al, J. Virol. 82: 5887-5911 (2008) (incorporated herein by reference in its entirety). In some embodiments, AAV refers all serotypes, subtypes, and naturally-occurring AAV as well as recombinant AAV. AAV may be used to refer to the virus itself or a derivative thereof. In some embodiments, AAV includes AAV1, AAV2, AAV3, AAV3B, AAV4, AAV5, AAV6, AAV6.2, AAV7, AAVrh.64R1, AAVhu.37, AAVrh.8, AAVrh.32.33, AAV8, AAV9, AAV-DJ, AAV2/8, AAVrh10, AAVLK03, AV10, AAV11, AAV 12, rh1O, and hybrids thereof, avian AAV, bovine AAV, canine AAV, equine AAV, primate AAV, non-primate AAV, and ovine AAV. The genomic sequences of various serotypes of AAV, as well as the sequences of the native terminal repeats (TRs), Rep proteins, and capsid subunits are known in the art. Such sequences may be found in the literature or in public databases such as GenBank. Additional exemplary AAV serotypes are listed in Table 18.

TABLE 18

Exemplary AAV serotypes.

| Target Tissue | Vehicle | Reference |
|---|---|---|
| Liver | AAV (AAV8[1], AAVrh.8[1], AAVhu.37[1], AAV2/8, AAV2/rh10[2], AAV9, AAV2, NP40[3], NP59[2,3], AAV3B[5], AAV-DJ[4], AAV-LK01[4], AAV-LK02[4], AAV-LK03[4], AAV-LK19[4], AAV5[7] Adenovirus (Ad5, HC-AdV[6]) | 1. Wang et al., *Mol. Ther.* 18, 118-25 (2010) 2. Ginn et al., *JHEP Reports*, 100065 (2019) 3. Paulk et al., *Mol. Ther.* 26, 289-303 (2018). 4. L. Lisowski et al., *Nature.* 506, 382-6 (2014). 5. L. Wang et al., *Mol. Ther.* 23, 1877-87 (2015). |

TABLE 18-continued

Exemplary AAV serotypes.

| Target Tissue | Vehicle | Reference |
|---|---|---|
| | | 6. Hausl Mol Ther (2010) |
| | | 7. Davidoff et al., Mol. Ther. 11, 875-88 (2005) |
| Lung | AAV (AAV4, AAV5, AAV6[1], AAV9, H22[2]) | 1. Duncan et al., Mol Ther Methods Clin Dev (2018) |
| | Adenovirus (Ad5, Ad3, Ad21, Ad14)[3] | 2. Cooney et al., Am J Respir Cell Mol Biol (2019) |
| | | 3. Li et al., Mol Ther Methods Clin Dev (2019) |
| Skin | AAV (AAV6[1], AAV-LK19[2]) | 1. Petek et al., Mol. Ther. (2010) |
| | | 2. L. Lisowski et al., Nature. 506, 382-6 (2014). |
| HSCs | Adenovirus (HDAd5/35[++]) | Wang et al. Blood Adv (2019) |

In some embodiments, a pharmaceutical composition (e.g., comprising an AAV as described herein) has less than 10% empty capsids, less than 8% empty capsids, less than 7% empty capsids, less than 5% empty capsids, less than 3% empty capsids, or less than 1% empty capsids. In some embodiments, the pharmaceutical composition has less than about 5% empty capsids. In some embodiments, the number of empty capsids is below the limit of detection. In some embodiments, it is advantageous for the pharmaceutical composition to have low amounts of empty capsids, e.g., because empty capsids may generate an adverse response (e.g., immune response, inflammatory response, liver response, and/or cardiac response), e.g., with little or no substantial therapeutic benefit.

In some embodiments, the residual host cell protein (rHCP) in the pharmaceutical composition is less than or equal to 100 ng/ml rHCP per $1\times10^{13}$ vg/ml, e.g., less than or equal to 40 ng/ml rHCP per $1\times10^{13}$ vg/ml or 1-50 ng/ml rHCP per $1\times10^{13}$ vg/ml. In some embodiments, the pharmaceutical composition comprises less than 10 ng rHCP per $1.0\times10^{13}$ vg, or less than 5 ng rHCP per $1.0\times10^{13}$ vg, less than 4 ng rHCP per $1.0\times10^{13}$ vg, or less than 3 ng rHCP per $1.0\times10^{13}$ vg, or any concentration in between. In some embodiments, the residual host cell DNA (hcDNA) in the pharmaceutical composition is less than or equal to $5\times10^6$ pg/ml hcDNA per $1\times10^{13}$ vg/ml, less than or equal to $1.2\times10^6$ pg/m hcDNA per $1\times10^{13}$ vg/ml, or $1\times10^5$ pg/ml hcDNA per $1\times10^{13}$ vg/ml. In some embodiments, the residual host cell DNA in said pharmaceutical composition is less than $5.0\times10^5$ pg per $1\times10^{13}$ vg, less than $2.0\times10^5$ pg per $1.0\times10^{13}$ vg, less than $1.1\times10^5$ pg per $1.0\times10^{13}$ vg, less than $1.0\times10^5$ pg hcDNA per $1.0\times10^{13}$ vg, less than $0.9\times10^5$ pg hcDNA per $1.0\times10^{13}$ vg, less than $0.8\times10^5$ pg hcDNA per $1.0\times10^{13}$ vg, or any concentration in between.

In some embodiments, the residual plasmid DNA in the pharmaceutical composition is less than or equal to $1.7\times10^5$ pg/ml per $1.0\times10^{13}$ vg/ml, or $1\times10^5$ pg/ml per $1\times1.0\times10^{13}$ vg/ml, or $1.7\times10^6$ pg/ml per $1.0\times10^{13}$ vg/ml. In some embodiments, the residual DNA plasmid in the pharmaceutical composition is less than $10.0\times10^5$ pg by $1.0\times10^{13}$ vg, less than $8.0\times10^5$ pg by $1.0\times10^{13}$ vg or less than $6.8\times10^5$ pg by $1.0\times10^{13}$ vg. In embodiments, the pharmaceutical composition comprises less than 0.5 ng per $1.0\times10^{13}$ vg, less than 0.3 ng per $1.0\times10^{13}$ vg, less than 0.22 ng per $1.0\times10^{13}$ vg or less than 0.2 ng per $1.0\times10^{13}$ vg or any intermediate concentration of bovine serum albumin (BSA). In embodiments, the benzonase in the pharmaceutical composition is less than 0.2 ng by $1.0\times10^{13}$ vg, less than 0.1 ng by $1.0\times10^{13}$ vg, less than 0.09 ng by $1.0\times10^{13}$ vg, less than 0.08 ng by $1.0\times10^{13}$ vg or any intermediate concentration. In embodiments, Poloxamer 188 in the pharmaceutical composition is about 10 to 150 ppm, about 15 to 100 ppm or about 20 to 80 ppm. In embodiments, the cesium in the pharmaceutical composition is less than 50 pg/g (ppm), less than 30 pg/g (ppm) or less than 20 pg/g (ppm) or any intermediate concentration.

In embodiments, the pharmaceutical composition comprises total impurities, e.g., as determined by SDS-PAGE, of less than 10%, less than 8%, less than 7%, less than 6%, less than 5%, less than 4%, less than 3%, less than 2%, or any percentage in between. In embodiments, the total purity, e.g., as determined by SDS-PAGE, is greater than 90%, greater than 92%, greater than 93%, greater than 94%, greater than 95%, greater than 96%, greater than 97%, greater than 98%, or any percentage in between. In embodiments, no single unnamed related impurity, e.g., as measured by SDS-PAGE, is greater than 5%, greater than 4%, greater than 3% or greater than 2%, or any percentage in between. In embodiments, the pharmaceutical composition comprises a percentage of filled capsids relative to total capsids (e.g., peak 1+peak 2 as measured by analytical ultracentrifugation) of greater than 85%, greater than 86%, greater than 87%, greater than 88%, greater than 89%, greater than 90%, greater than 91%, greater than 91.9%, greater than 92%, greater than 93%, or any percentage in between. In embodiments of the pharmaceutical composition, the percentage of filled capsids measured in peak 1 by analytical ultracentrifugation is 20-80%, 25-75%, 30-75%, 35-75%, or 37.4-70.3%. In embodiments of the pharmaceutical composition, the percentage of filled capsids measured in peak 2 by analytical ultracentrifugation is 20-80%, 20-70%, 22-65%, 24-62%, or 24.9-60.1%.

In one embodiment, the pharmaceutical composition comprises a genomic titer of 1.0 to $5.0\times10^{13}$ vg/mL, 1.2 to $3.0\times10^{13}$ vg/mL or 1.7 to $2.3\times10^{13}$ vg/ml. In one embodiment, the pharmaceutical composition exhibits a biological load of less than 5 CFU/mL, less than 4 CFU/mL, less than 3 CFU/mL, less than 2 CFU/mL or less than 1 CFU/mL or any intermediate contraction. In embodiments, the amount of endotoxin according to USP, for example, USP <85> (incorporated by reference in its entirety) is less than 1.0 EU/mL, less than 0.8 EU/mL or less than 0.75 EU/mL. In embodiments, the osmolarity of a pharmaceutical composition according to USP, for example, USP <785> (incorporated by reference in its entirety) is 350 to 450 mOsm/kg, 370 to 440 mOsm/kg or 390 to 430 mOsm/kg. In embodiments, the pharmaceutical composition contains less than 1200 particles that are greater than 25 μm per container, less than 1000 particles that are greater than 25 μm per container, less than 500 particles that are greater than 25 μm per container or any intermediate value. In embodiments, the pharmaceutical composition contains less than 10,000 particles that are greater than 10 μm per container, less than 8000 particles that are greater than 10 μm per container or less than 600 particles that are greater than 10 μm per container.

In one embodiment, the pharmaceutical composition has a genomic titer of 0.5 to $5.0 \times 10^{13}$ vg/mL, 1.0 to $4.0 \times 10^{13}$ vg/mL, 1.5 to $3.0 \times 10^{13}$ vg/ml or 1.7 to $2.3 \times 10^{13}$ vg/ml. In one embodiment, the pharmaceutical composition described herein comprises one or more of the following: less than about 0.09 ng benzonase per $1.0 \times 10^{13}$ vg, less than about 30 pg/g (ppm) of cesium, about 20 to 80 ppm Poloxamer 188, less than about 0.22 ng BSA per $1.0 \times 10^{13}$ vg, less than about $6.8 \times 10^5$ pg of residual DNA plasmid per $1.0 \times 10^{13}$ vg, less than about $1.1 \times 10^5$ pg of residual hcDNA per $1.0 \times 10^{13}$ vg, less than about 4 ng of rHCP per $1.0 \times 10^{13}$ vg, pH 7.7 to 8.3, about 390 to 430 mOsm/kg, less than about 600 particles that are >25 μm in size per container, less than about 6000 particles that are >10 μm in size per container, about $1.7 \times 10^{13}$-$2.3 \times 10^{13}$ vg/mL genomic titer, infectious titer of about $3.9 \times 10^8$ to $8.4 \times 10^{10}$ IU per $1.0 \times 10^{13}$ vg, total protein of about 100-300 pg per $1.0 \times 10^{13}$ vg, mean survival of >24 days in A7SMA mice with about $7.5 \times 10^{13}$ vg/kg dose of viral vector, about 70 to 130% relative potency based on an in vitro cell based assay and/or less than about 5% empty capsid. In various embodiments, the pharmaceutical compositions described herein comprise any of the viral particles discussed here, retain a potency of between ±20%, between ±15%, between ±10% or within ±5% of a reference standard. In some embodiments, potency is measured using a suitable in vitro cell assay or in vivo animal model.

Additional methods of preparation, characterization, and dosing AAV particles are taught in WO2019094253, which is incorporated herein by reference in its entirety.

Additional rAAV constructs that can be employed consonant with the invention include those described in Wang et al 2019, available at: doi.org/10.1038/s41573-019-0012-9, including Table 1 thereof, which is incorporated by reference in its entirety.

Lipid Nanoparticles

The methods and systems provided herein may employ any suitable carrier or delivery modality, including, in certain embodiments, lipid nanoparticles (LNPs). Lipid nanoparticles, in some embodiments, comprise one or more ionic lipids, such as non-cationic lipids (e.g., neutral or anionic, or zwitterionic lipids); one or more conjugated lipids (such as PEG-conjugated lipids or lipids conjugated to polymers described in Table 5 of WO2019217941; incorporated herein by reference in its entirety); one or more sterols (e.g., cholesterol); and, optionally, one or more targeting molecules (e.g., conjugated receptors, receptor ligands, antibodies); or combinations of the foregoing.

Lipids that can be used in nanoparticle formations (e.g., lipid nanoparticles) include, for example those described in Table 4 of WO2019217941, which is incorporated by reference—e.g., a lipid-containing nanoparticle can comprise one or more of the lipids in Table 4 of WO2019217941. Lipid nanoparticles can include additional elements, such as polymers, such as the polymers described in Table 5 of WO2019217941, incorporated by reference.

In some embodiments, conjugated lipids, when present, can include one or more of PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2',3'-di(tetradecanoyloxy)propyl-1-0-(w-methoxy(polyethoxy)ethyl) butanedioate (PEG-S-DMG)), PEG dialkoxypropylcarbam, N-(carbonyl-methoxypoly ethylene glycol 2000)-1,2-distearoyl-sn-glycero-3-phosphoethanolamine sodium salt, and those described in Table 2 of WO2019051289 (incorporated by reference), and combinations of the foregoing.

In some embodiments, sterols that can be incorporated into lipid nanoparticles include one or more of cholesterol or cholesterol derivatives, such as those in WO2009/127060 or US2010/0130588, which are incorporated by reference. Additional exemplary sterols include phytosterols, including those described in Eygeris et al (2020), dx.doi.org/10.1021/acs.nanolett.0c01386, incorporated herein by reference.

In some embodiments, the lipid particle comprises an ionizable lipid, a non-cationic lipid, a conjugated lipid that inhibits aggregation of particles, and a sterol. The amounts of these components can be varied independently and to achieve desired properties. For example, in some embodiments, the lipid nanoparticle comprises an ionizable lipid is in an amount from about 20 mol % to about 90 mol % of the total lipids (in other embodiments it may be 20-70% (mol), 30-60% (mol) or 40-50% (mol); about 50 mol % to about 90 mol % of the total lipid present in the lipid nanoparticle), a non-cationic lipid in an amount from about 5 mol % to about 30 mol % of the total lipids, a conjugated lipid in an amount from about 0.5 mol % to about 20 mol % of the total lipids, and a sterol in an amount from about 20 mol % to about 50 mol % of the total lipids. The ratio of total lipid to nucleic acid (e.g., encoding the gene modifying polypeptide or template nucleic acid) can be varied as desired. For example, the total lipid to nucleic acid (mass or weight) ratio can be from about 10:1 to about 30:1.

In some embodiments, an ionizable lipid may be a cationic lipid, an ionizable cationic lipid, e.g., a cationic lipid that can exist in a positively charged or neutral form depending on pH, or an amine-containing lipid that can be readily protonated. In some embodiments, the cationic lipid is a lipid capable of being positively charged, e.g., under physiological conditions. Exemplary cationic lipids include one or more amine group(s) which bear the positive charge. In some embodiments, the lipid particle comprises a cationic lipid in formulation with one or more of neutral lipids, ionizable amine-containing lipids, biodegradable alkyn lipids, steroids, phospholipids including polyunsaturated lipids, structural lipids (e.g., sterols), PEG, cholesterol and polymer conjugated lipids. In some embodiments, the cationic lipid may be an ionizable cationic lipid. An exemplary cationic lipid as disclosed herein may have an effective pKa over 6.0. In embodiments, a lipid nanoparticle may comprise a second cationic lipid having a different effective pKa (e.g., greater than the first effective pKa), than the first cationic lipid. A lipid nanoparticle may comprise between 40 and 60 mol percent of a cationic lipid, a neutral lipid, a steroid, a polymer conjugated lipid, and a therapeutic agent, e.g., a nucleic acid (e.g., RNA) described herein (e.g., a template nucleic acid or a nucleic acid encoding a gene modifying polypeptide), encapsulated within or associated with the lipid nanoparticle. In some embodiments, the nucleic acid is co-formulated with the cationic lipid. The nucleic acid may be adsorbed to the surface of an LNP, e.g., an LNP comprising a cationic lipid. In some embodiments, the nucleic acid may be encapsulated in an LNP, e.g., an LNP comprising a cationic lipid. In some embodiments, the lipid nanoparticle may comprise a targeting moiety, e.g., coated with a targeting agent. In embodiments, the LNP formulation is biodegradable. In some embodiments, a lipid nanoparticle comprising one or more lipid described herein, e.g., Formula (i), (ii), (ii), (vii) and/or (ix) encapsulates at least 1%, at least 5%, at least 10%, at least 20%, at least 30%, at least 40%, at least 50%, at least 60%, at least 70%, at least 80%, at least 90%, at least 92%, at least 95%, at least 97%, at least 98% or 100% of an RNA molecule, e.g., template RNA and/or a mRNA encoding the gene modifying polypeptide.

In some embodiments, the lipid to nucleic acid ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and nucleic acid can be adjusted to provide a desired N/P ratio, for example, N/P ratio of 3, 4, 5, 6, 7, 8, 9, 10 or higher. Generally, the lipid nanoparticle formulation's overall lipid content can range from about 5 mg/ml to about 30 mg/mL.

Exemplary ionizable lipids that can be used in lipid nanoparticle formulations include, without limitation, those listed in Table 1 of WO2019051289, incorporated herein by reference. Additional exemplary lipids include, without limitation, one or more of the following formulae: X of US2016/0311759; I of US20150376115 or in US2016/0376224; I, II or III of US20160151284; I, IA, II, or IIA of US20170210967; I-c of US20150140070; A of US2013/0178541; I of US2013/0303587 or US2013/0123338; I of US2015/0141678; II, III, IV, or V of US2015/0239926; I of US2017/0119904; I or II of WO2017/117528; A of US2012/0149894; A of US2015/0057373; A of WO2013/116126; A of US2013/0090372; A of US2013/0274523; A of US2013/0274504; A of US2013/0053572; A of WO2013/016058; A of WO2012/162210; I of US2008/042973; I, II, III, or IV of US2012/01287670; I or II of US2014/0200257; I, II, or III of US2015/0203446; I or III of US2015/0005363; I, IA, IB, IC, ID, II, IIA, IIB, IIC, IID, or III-XXIV of US2014/0308304; of US2013/0338210; I, II, III, or IV of WO2009/132131; A of US2012/01011478; I or XXXV of US2012/0027796; XIV or XVII of US2012/0058144; of US2013/0323269; I of US 2011/0117125; I, II, or III of US2011/0256175; I, II, III, IV, V, VI, VII, VIII, IX, X, XI, XII of US2012/0202871; I, II, III, IV, V, VI, VII, VIII, X, XII, XIII, XIV, XV, or XVI of US2011/0076335; I or II of US2006/008378; I of US2013/0123338; I or X-A-Y-Z of US2015/0064242; XVI, XVII, or XVIII of US2013/0022649; I, II, or III of US2013/0116307; I, II, or III of US2013/0116307; I or II of US2010/0062967; I-X of US2013/0189351; I of US2014/0039032; V of US2018/0028664; I of US2016/0317458; I of US 2013/0195920; 5, 6, or 10 of U.S. Pat. No. 10,221,127; 111-3 of WO2018/081480; 1-5 or 1-8 of WO2020/081938; 18 or 25 of U.S. Pat. No. 9,867,888; A of US2019/0136231; II of WO2020/219876; 1 of US2012/0027803; OF-02 of US2019/0240349; 23 of U.S. Pat. No. 10,086,013; cKK-E12/A6 of Miao et al (2020); C12-200 of WO2010/053572; 7C1 of Dahhman et al (2017); 304-013 or 503-013 of Whitehead et al; TS-P4C2 of U.S. Pat. No. 9,708,628; I of WO2020/106946; I of WO2020/106946.

In some embodiments, the ionizable lipid is MC3 (6Z, 9Z,28Z,3 1Z)-heptatriaconta-6,9,28,3 1-tetraen-19-yl-4-(dimethylamino) butanoate (DLin-MC3-DMA or MC3), e.g., as described in Example 9 of WO2019051289A9 (incorporated by reference herein in its entirety). In some embodiments, the ionizable lipid is the lipid ATX-002, e.g., as described in Example 10 of WO2019051289A9 (incorporated by reference herein in its entirety). In some embodiments, the ionizable lipid is (13Z,16Z)-A,A-dimethyl-3-nonyldocosa-13, 16-dien-1-amine (Compound 32), e.g., as described in Example 11 of WO2019051289A9 (incorporated by reference herein in its entirety). In some embodiments, the ionizable lipid is Compound 6 or Compound 22, e.g., as described in Example 12 of WO2019051289A9 (incorporated by reference herein in its entirety). In some embodiments, the ionizable lipid is heptadecan-9-yl 8-((2-hydroxyethyl)(6-oxo-6-(undecyloxy)hexyl)amino)octanoate (SM-102); e.g., as described in Example 1 of U.S. Pat. No. 9,867,888 (incorporated by reference herein in its entirety). In some embodiments, the ionizable lipid is 9Z,12Z)-3-((4,4-bis(octyloxy)butanoyl)oxy)-2-((((3-(diethylamino)propoxy)carbonyl)oxy)methyl)propyl octadeca-9, 12-dienoate (LP01) e.g., as synthesized in Example 13 of WO2015/095340 (incorporated by reference herein in its entirety). In some embodiments, the ionizable lipid is Di((Z)-non-2-en-1-yl) 9-((4-dimethylamino)butanoyl)oxy) heptadecanedioate (L319), e.g. as synthesized in Example 7, 8, or 9 of US2012/0027803 (incorporated by reference herein in its entirety). In some embodiments, the ionizable lipid is 1,1'-((2-(4-(2-((2-(Bis(2-hydroxydodecyl)amino) ethyl)(2-hydroxydodecyl) amino)ethyl)piperazin-1-yl) ethyl)azanediyl)bis(dodecan-2-ol) (C12-200), e.g., as synthesized in Examples 14 and 16 of WO2010/053572 (incorporated by reference herein in its entirety). In some embodiments, the ionizable lipid is; Imidazole cholesterol ester (ICE) lipid (3S,10R, 13R, 17R)-10, 13-dimethyl-17-((R)-6-methylheptan-2-yl)-2, 3, 4, 7, 8, 9, 10, 11, 12, 13, 14, 15, 16, 17-tetradecahydro-1H-cyclopenta[a]phenanthren-3-yl 3-(1H-imidazol-4-yl)propanoate, e.g., Structure (I) from WO2020/106946 (incorporated by reference herein in its entirety).

Some non-limiting examples of lipid compounds that may be used (e.g., in combination with other lipid components) to form lipid nanoparticles for the delivery of compositions described herein, e.g., nucleic acid (e.g., RNA) described herein (e.g., a template nucleic acid or a nucleic acid encoding a gene modifying polypeptide) includes,

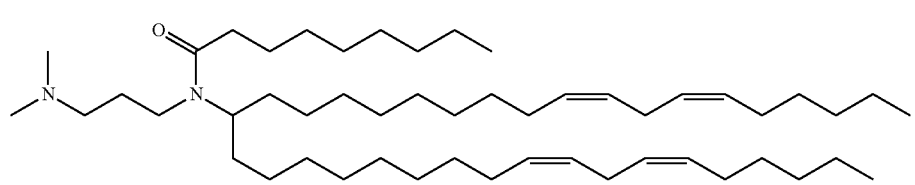

(i)

In some embodiments an LNP comprising Formula (i) is used to deliver a gene modifying composition described herein to the liver and/or hepatocyte cells.

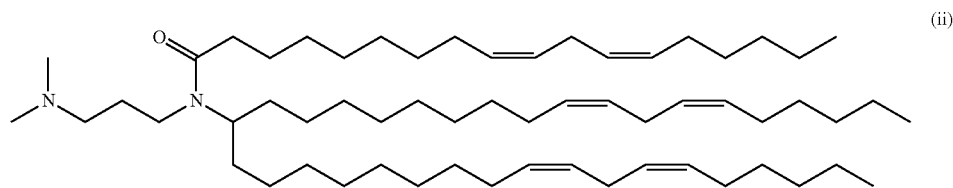 [SMILES: CCCCC/C=C\C/C=C\CCCCCCCCC(CCCCCCCC/C=C\C/C=C\CCCCC)N(CCCN(C)C)C(=O)CCCCCCC/C=C\C/C=C\CCCCC]
(ii)

In some embodiments an LNP comprising Formula (ii) is used to deliver a gene modifying composition described herein to the liver and/or hepatocyte cells.

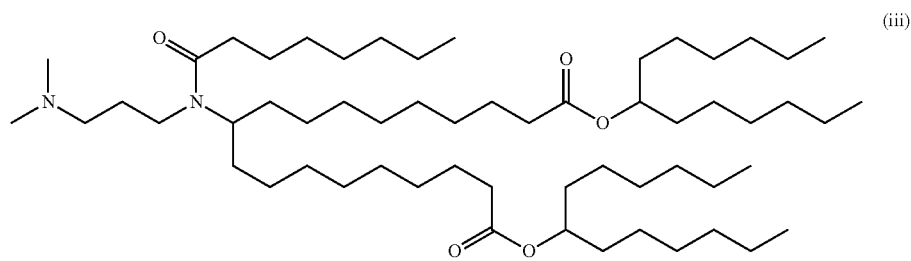 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC]
(iii)

In some embodiments an LNP comprising Formula (iii) is used to deliver a gene modifying composition described herein to the liver and/or hepatocyte cells.

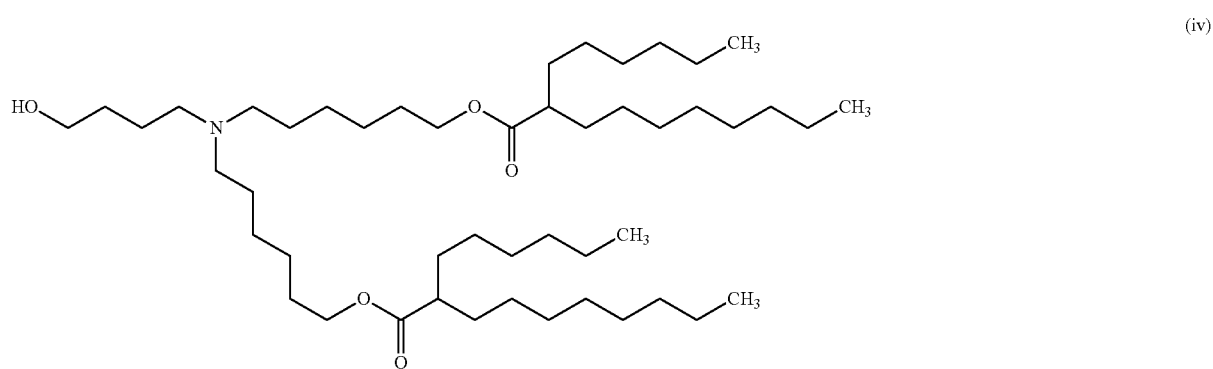
(iv)

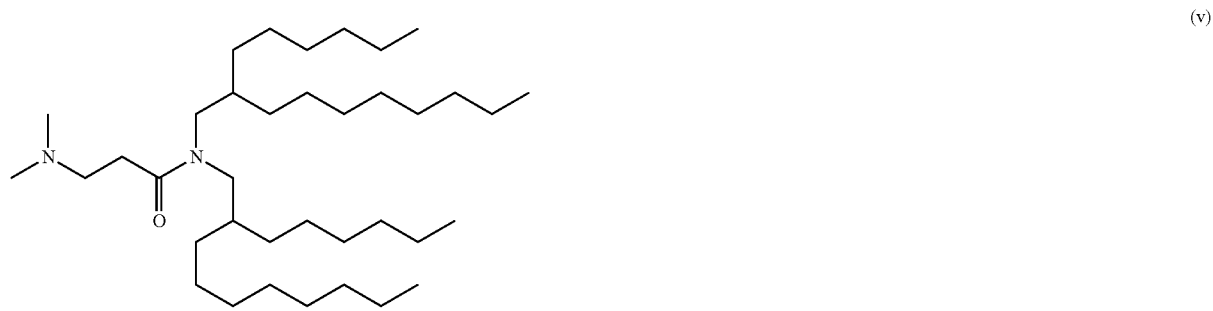
(v)

In some embodiments an LNP comprising Formula (v) is used to deliver a gene modifying composition described herein to the liver and/or hepatocyte cells.

(vi)

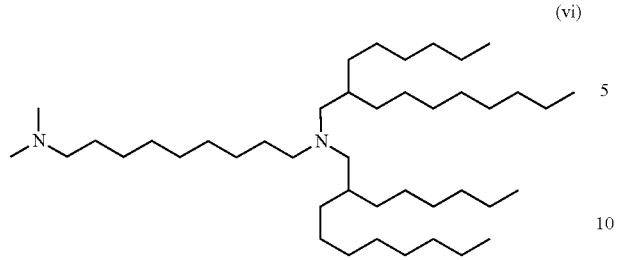

In some embodiments an LNP comprising Formula (vi) is used to deliver a gene modifying composition described herein to the liver and/or hepatocyte cells.

(vii)

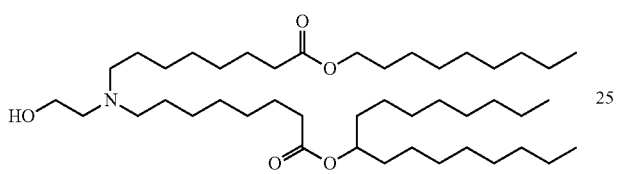

(viii)

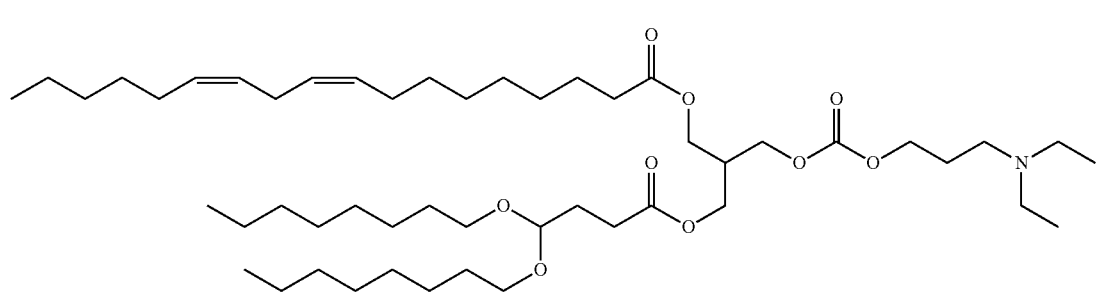

In some embodiments an LNP comprising Formula (viii) is used to deliver a gene modifying composition described herein to the liver and/or hepatocyte cells.

In some embodiments an LNP comprising Formula (ix) is used to deliver a gene modifying composition described herein to the liver and/or hepatocyte cells.

(x)

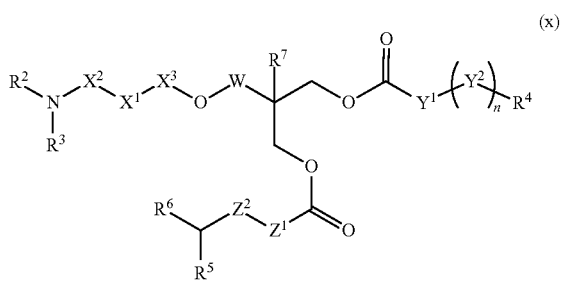

wherein $X^1$ is O, $NR^1$, or a direct bond, $X^2$ is C2-5 alkylene, $X^3$ is C(=O) or a direct bond, $R^1$ is H or Me, $R^3$ is Ci-3 alkyl, $R^2$ is Ci-3 alkyl, or $R^2$ taken together with the nitrogen atom to which it is attached and 1-3 carbon atoms of $X^2$ form a 4-, 5-, or 6-membered ring, or $X^1$ is $NR^2$, $R^1$ and $R^2$ taken together with the nitrogen atoms to which they are attached form a 5- or 6-membered ring, or $R^2$ taken together with $R^3$ and the nitrogen atom to which they are attached form a 5-, 6-, or 7-membered ring, $Y^1$ is C2-12 alkylene, $Y^2$ is selected from

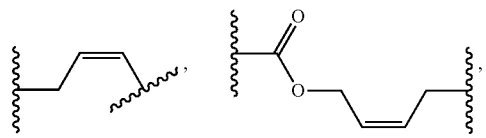

(in either orientation)    (in either orientation)

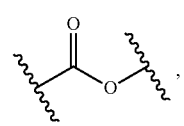

(in either orientation)

n is 0 to 3, $R^4$ is Ci-15 alkyl, $Z^1$ is Ci-6 alkylene or a direct bond, (ix)

$Z^2$ is

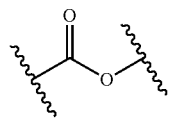 [SMILES: *OC(*)=O]

(in either orientation) or absent, provided that if $Z^1$ is a direct bond, $Z^2$ is absent;

$R^5$ is C5-9 alkyl or C6-10 alkoxy, $R^6$ is C5-9 alkyl or C6-10 alkoxy, W is methylene or a direct bond, and $R^7$ is H or Me, or a salt thereof, provided that if $R^3$ and $R^2$ are C2 alkyls, $X^1$ is O, $X^2$ is linear C3 alkylene, $X^3$ is C(=O), $Y^1$ is linear Ce alkylene, $(Y^2)n-R^4$ is

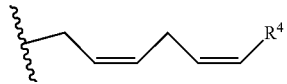

$R^4$ is linear C5 alkyl, $Z^1$ is C2 alkylene, $Z^2$ is absent, W is methylene, and $R^7$ is H, then $R^5$ and $R^6$ are not Cx alkoxy.

In some embodiments an LNP comprising Formula (xii) is used to deliver a gene modifying composition described herein to the liver and/or hepatocyte cells.

(xi)

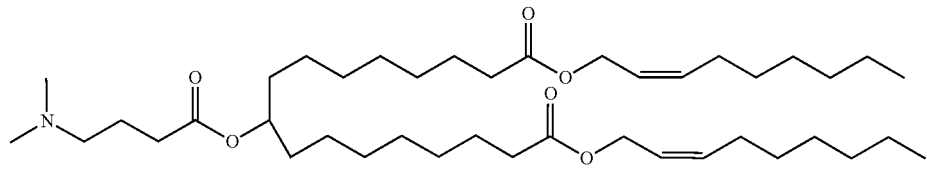

In some embodiments an LNP comprising Formula (xi) is used to deliver a gene modifying composition described herein to the liver and/or hepatocyte cells.

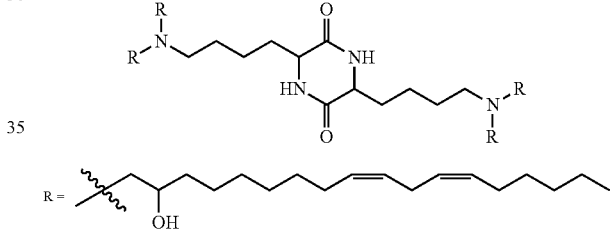

OF-02 where (xii)

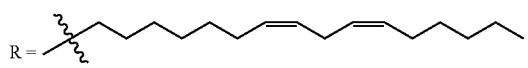

(xiii)

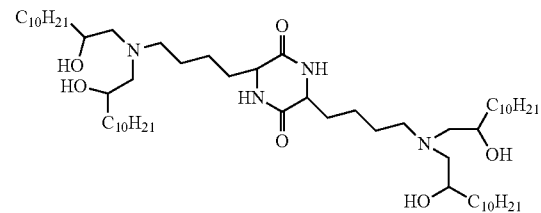

(xiv)

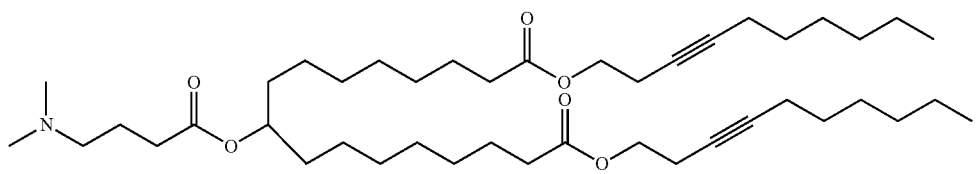

In some embodiments an LNP comprises a compound of Formula (xiii) and a compound of Formula (xiv).

(xv)

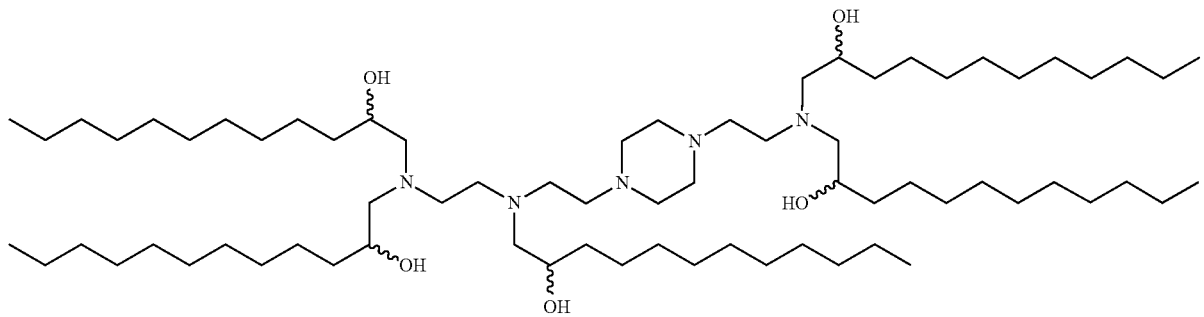

In some embodiments an LNP comprising Formula (xv) is used to deliver a gene modifying composition described herein to the liver and/or hepatocyte cells.

(xvi)

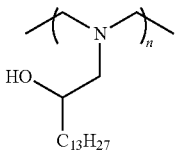

PEI$_{600}$ Core

In some embodiments an LNP comprising a formulation of Formula (xvi) is used to deliver a gene modifying composition described herein to the lung endothelial cells.

(xvii)

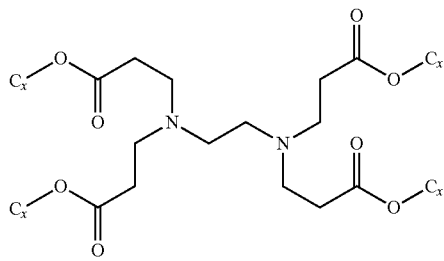

(xviii)

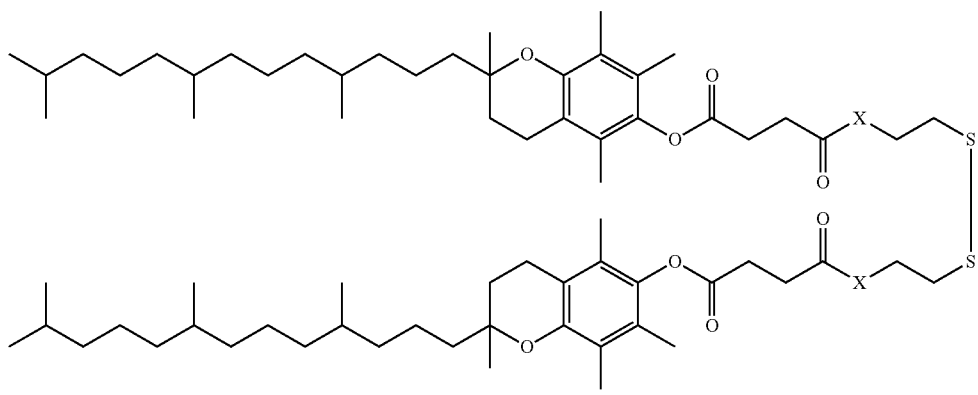

X = amino structure where X = 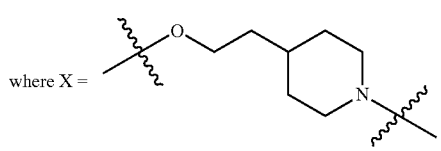

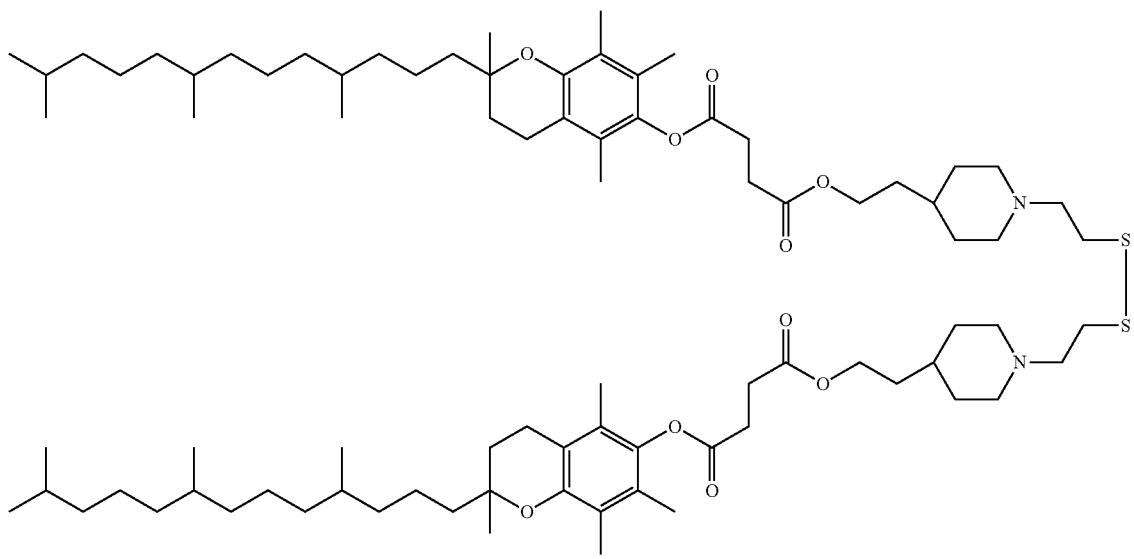

(xviii)(b)

(xix)

In some embodiments, a lipid compound used to form lipid nanoparticles for the delivery of compositions described herein, e.g., nucleic acid (e.g., RNA) described herein (e.g., a template nucleic acid or a nucleic acid encoding a gene modifying polypeptide) is made by one of the following reactions:

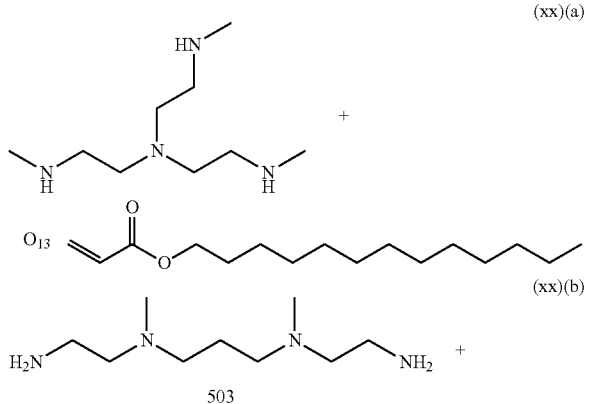

(xx)(a)

(xx)(b)

-continued

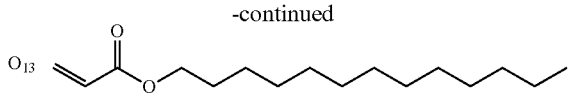

Exemplary non-cationic lipids include, but are not limited to, distearoyl-sn-glycero-phosphoethanolamine, distearoylphosphatidylcholine (DSPC), dioleoylphosphatidylcholine (DOPC), dipahnitoylphosphatidylcholine (DPPC), dioleoylphosphatidylglycerol (DOPG), dipahnitoylphosphatidylglycerol (DPPG), dioleoyl-phosphatidylethanolamine (DOPE), 1,2-dioleoyl-sn-glycero-3-phosphoethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), monomethyl-phosphatidylethanolamine (such as 16-O-monomethyl PE), dimethyl-phosphatidylethanolamine (such as 16-O-dimethyl PE), 18-1-trans PE, 1-stearoyl-2-oleoyl-phosphatidyethanolamine (SOPE), hydrogenated soy phosphatidylcholine (HSPC), egg phosphatidylcholine (EPC), dioleoylphosphatidylserine (DOPS), sphingomyelin (SM), dimyristoyl phosphatidylcholine (DMPC), dimyristoyl phosphatidylglycerol (DMPG), distearoylphosphatidylglycerol (DSPG), dierucoylphosphatidylcholine (DEPC), palmitoyloleyolphosphatidylglycerol (POPG), dielaidoyl-phosphatidylethanolamine (DEPE), lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidicacid, cerebrosides, dicetylphosphate, lysophosphatidylcholine, dilinoleoylphosphatidylcholine, or mixtures thereof. It is understood that other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, paimitoyl, stearoyl, or oleoyl. Additional exemplary lipids, in certain embodiments, include, without limitation, those described in Kim et al. (2020) dx.doi.org/10.1021/acs.nanolett.0c01386, incorporated herein by reference. Such lipids include, in some embodiments, plant lipids found to improve liver transfection with mRNA (e.g., DGTS). In some embodiments, the non-cationic lipid may have the following structure, logues such as 5a-cholestane, cholestenone, 5a-cholestanone, 5p-cholestanone, and cholesteryl decanoate; and mixtures thereof. In some embodiments, the cholesterol derivative is a polar analogue, e.g., choiesteryl-(4'-hydroxy)-butyl ether. Exemplary cholesterol derivatives are described in PCT publication WO2009/127060 and US patent publication US2010/0130588, each of which is incorporated herein by reference in its entirety.

In some embodiments, the component providing membrane integrity, such as a sterol, can comprise 0-50% (mol) (e.g., 0-10%, 10-20%, 20-30%, 30-40%, or 40-50%) of the total lipid present in the lipid nanoparticle. In some embodiments, such a component is 20-50% (mol) 30-40% (mol) of the total lipid content of the lipid nanoparticle.

In some embodiments, the lipid nanoparticle can comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as ATTA-lipid conjugates), cationic-polymer lipid (CPL) conjugates, and mixtures thereof. In some embodiments, the conjugated lipid (xxi)

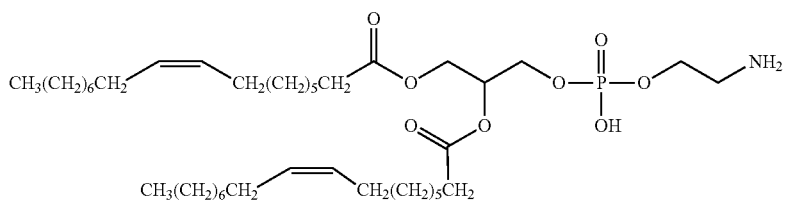

Other examples of non-cationic lipids suitable for use in the lipid nanopartieles include, without limitation, nonphosphorous lipids such as, e.g., stearylamine, dodeeylamine, hexadecylamine, acetyl palmitate, glycerol ricinoleate, hexadecyl stereate, isopropyl myristate, amphoteric acrylic polymers, triethanolamine-lauryl sulfate, alkyl-aryl sulfate polyethyloxylated fatty acid amides, dioctadecyl dimethyl ammonium bromide, ceramide, sphingomyelin, and the like. Other non-cationic lipids are described in WO2017/099823 or US patent publication US2018/0028664, the contents of which is incorporated herein by reference in their entirety.

In some embodiments, the non-cationic lipid is oleic acid or a compound of Formula I, II, or IV of US2018/0028664, incorporated herein by reference in its entirety. The non-cationic lipid can comprise, for example, 0-30% (mol) of the total lipid present in the lipid nanoparticle. In some embodiments, the non-cationic lipid content is 5-20% (mol) or 10-15% (mol) of the total lipid present in the lipid nanoparticle. In embodiments, the molar ratio of ionizable lipid to the neutral lipid ranges from about 2:1 to about 8:1 (e.g., about 2:1, 3:1, 4:1, 5:1, 6:1, 7:1, or 8:1).

In some embodiments, the lipid nanoparticles do not comprise any phospholipids.

In some embodiments, the lipid nanoparticle can further comprise a component, such as a sterol, to provide membrane integrity. One exemplary sterol that can be used in the lipid nanoparticle is cholesterol and derivatives thereof. Non-limiting examples of cholesterol derivatives include polar analogues such as 5a-choiestanol, 53-coprostanol, choiesteryl-(2,-hydroxy)-ethyl ether, choiesteryl-(4'-hydroxy)-butyl ether, and 6-ketocholestanol; non-polar anamolecule is a PEG-lipid conjugate, for example, a (methoxy polyethylene glycol)-conjugated lipid.

Exemplary PEG-lipid conjugates include, but are not limited to, PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), 1,2-dimyristoyl-sn-glycerol, methoxypoly ethylene glycol (DMG-PEG-2K), PEG succinate diacylglycerol (PEGS-DAG) (such as 4-0-(2', 3'-di(tetradecanoyloxy)propyl-1-0-(w-methoxy(polyethoxy) ethyl) butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, US2017/0119904, and US/099823, the contents of all of which are incorporated herein by reference in their entirety. In some embodiments, a PEG-lipid is a compound of Formula III, III-a-I, III-a-2, III-b-1, III-b-2, or V of US2018/0028664, the content of which is incorporated herein by reference in its entirety. In some embodiments, a PEG-lipid is of Formula II of US20150376115 or US2016/0376224, the content of both of which is incorporated herein by reference in its entirety. In some embodiments, the PEG-DAA conjugate can be, for example, PEG-dilauryloxypropyl, PEG-dimyristyloxypropyl, PEG-dipalnityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-disterylglycamide, PEG-cholesterol (1-[8'-(Cholest-5-en-3[beta]-oxy)carboxamido-3',6'-dioxaoctanyl]carbamoyl-[omega]-methyl-poly(ethylene glycol), PEG-DMB (3,4-Ditetradecoxylbenzyl-[omega]-methyl-poly(ethylene glycol) ether), and 1,2-dimyristoyl-sn-glycero-3-phosphoethanolamine-N-[methoxy(polyethylene glycol)-2000]. In some embodiments, the PEG-lipid comprises PEG-DMG, 1,2-dimyristoyl-sn-glycero-3-phosphoethanolamine-N-[methoxy(polyethylene glycol)-2000]. In some embodiments, the PEG-lipid comprises a structure selected from:

In some embodiments, a lipid nanoparticle may comprise one or more cationic lipids selected from Formula (i), Formula (ii), Formula (iii), Formula (vii), and Formula (ix). In some embodiments, the LNP may further comprise one or more neutral lipid, e.g., DSPC, DPPC, DMPC, DOPC, POPC, DOPE, SM, a steroid, e.g., cholesterol, and/or one or more polymer conjugated lipid, e.g., a pegylated lipid, e.g., PEG-DAG, PEG-PE, PEG-S-DAG, PEG-cer or a PEG dialkyoxypropylcarbamate.

In some embodiments, the PEG or the conjugated lipid can comprise 0-20% (mol) of the total lipid present in the lipid nanoparticle. In some embodiments, PEG or the conjugated lipid content is 0.5-10% or 2-5% (mol) of the total

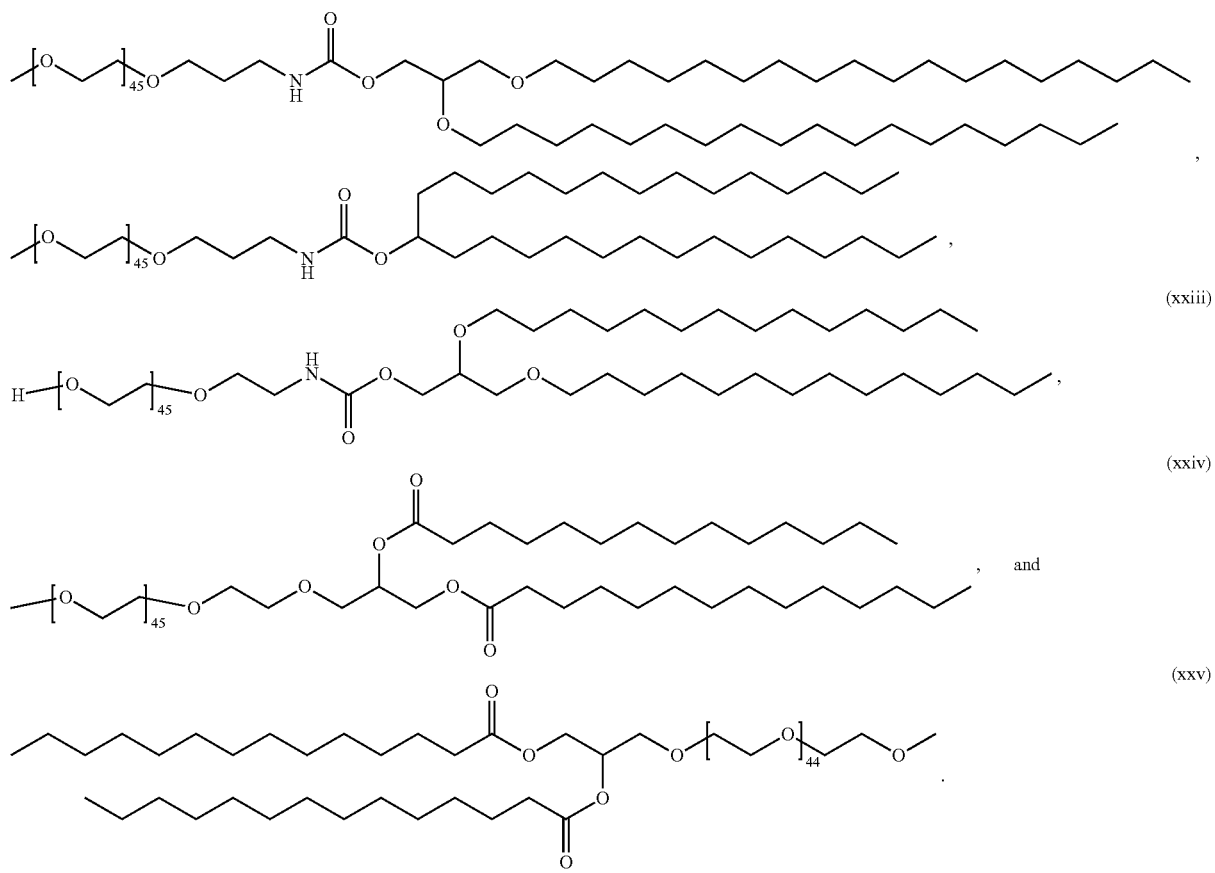

In some embodiments, lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (GPL) conjugates can be used in place of or in addition to the PEG-lipid. Exemplary conjugated lipids, i.e., PEG-lipids, (POZ)-lipid conjugates, ATTA-lipid conjugates and cationic polymer-lipids are described in the PCT and LIS patent applications listed in Table 2 of WO2019051289A9 and in WO2020106946A1, the contents of all of which are incorporated herein by reference in their entirety.

In some embodiments an LNP comprises a compound of Formula (xix), a compound of Formula (xxi) and a compound of Formula (xxv). In some embodiments an LNP comprising a formulation of Formula (xix), Formula (xxi) and Formula (xxv) is used to deliver a gene modifying composition described herein to the lung or pulmonary cells.

lipid present in the lipid nanoparticle. Molar ratios of the ionizable lipid, non-cationic-lipid, sterol, and PEG/conjugated lipid can be varied as needed. For example, the lipid particle can comprise 30-70% ionizable lipid by mole or by total weight of the composition, 0-60% cholesterol by mole or by total weight of the composition, 0-30% non-cationic-lipid by mole or by total weight of the composition and 1-10% conjugated lipid by mole or by total weight of the composition. Preferably, the composition comprises 30-40% ionizable lipid by mole or by total weight of the composition, 40-50% cholesterol by mole or by total weight of the composition, and 10-20% non-cationic-lipid by mole or by total weight of the composition. In some other embodiments, the composition is 50-75% ionizable lipid by mole or by total weight of the composition, 20-40% cholesterol by mole or by total weight of the composition, and 5 to 10% non-cationic-lipid, by mole or by total weight of the composition and 1-10% conjugated lipid by mole or by total weight of the composition. The composition may contain 60-70% ionizable lipid by mole or by total weight of the composition, 25-35% cholesterol by mole or by total weight of the composition, and 5-10% non-cationic-lipid by mole or by total weight of the composition. The composition may also contain up to 90% ionizable lipid by mole or by total weight of the composition and 2 to 15% non-cationic lipid by mole or by total weight of the composition. The formulation may also be a lipid nanoparticle formulation, for example comprising 8-30% ionizable lipid by mole or by total weight of the composition, 5-30% non-cationic lipid by mole or by total weight of the composition, and 0-20% cholesterol by mole or by total weight of the composition; 4-25% ionizable lipid by mole or by total weight of the composition, 4-25% non-cationic lipid by mole or by total weight of the composition, 2 to 25% cholesterol by mole or by total weight of the composition, 10 to 35% conjugate lipid by mole or by total weight of the composition, and 5% cholesterol by mole or by total weight of the composition; or 2-30% ionizable lipid by mole or by total weight of the composition, 2-30% non-cationic lipid by mole or by total weight of the composition, 1 to 15% cholesterol by mole or by total weight of the composition, 2 to 35% conjugate lipid by mole or by total weight of the composition, and 1-20% cholesterol by mole or by total weight of the composition; or even up to 90% ionizable lipid by mole or by total weight of the composition and 2-10% non-cationic lipids by mole or by total weight of the composition, or even 100% cationic lipid by mole or by total weight of the composition. In some embodiments, the lipid particle formulation comprises ionizable lipid, phospholipid, cholesterol and a PEG-ylated lipid in a molar ratio of 50:10:38.5:1.5. In some other embodiments, the lipid particle formulation comprises ionizable lipid, cholesterol and a PEG-ylated lipid in a molar ratio of 60:38.5:1.5.

In some embodiments, the lipid particle comprises ionizable lipid, non-cationic lipid (e.g. phospholipid), a sterol (e.g., cholesterol) and a PEG-ylated lipid, where the molar ratio of lipids ranges from 20 to 70 mole percent for the ionizable lipid, with a target of 40-60, the mole percent of non-cationic lipid ranges from 0 to 30, with a target of 0 to 15, the mole percent of sterol ranges from 20 to 70, with a target of 30 to 50, and the mole percent of PEG-ylated lipid ranges from 1 to 6, with a target of 2 to 5.

In some embodiments, the lipid particle comprises ionizable lipid/non-cationic-lipid/sterol/conjugated lipid at a molar ratio of 50:10:38.5:1.5.

In an aspect, the disclosure provides a lipid nanoparticle formulation comprising phospholipids, lecithin, phosphatidylcholine and phosphatidylethanolamine.

In some embodiments, one or more additional compounds can also be included. Those compounds can be administered separately or the additional compounds can be included in the lipid nanoparticles of the invention. In other words, the lipid nanoparticles can contain other compounds in addition to the nucleic acid or at least a second nucleic acid, different than the first. Without limitations, other additional compounds can be selected from the group consisting of small or large organic or inorganic molecules, monosaccharides, disaccharides, trisaccharides, oligosaccharides, polysaccharides, peptides, proteins, peptide analogs and derivatives thereof, peptidomimetics, nucleic acids, nucleic acid analogs and derivatives, an extract made from biological materials, or any combinations thereof.

In some embodiments, a lipid nanoparticle (or a formulation comprising lipid nanoparticles) lacks reactive impurities (e.g., aldehydes or ketones), or comprises less than a preselected level of reactive impurities (e.g., aldehydes or ketones). While not wishing to be bound by theory, in some embodiments, a lipid reagent is used to make a lipid nanoparticle formulation, and the lipid reagent may comprise a contaminating reactive impurity (e.g., an aldehyde or ketone). A lipid regent may be selected for manufacturing based on having less than a preselected level of reactive impurities (e.g., aldehydes or ketones). Without wishing to be bound by theory, in some embodiments, aldehydes can cause modification and damage of RNA, e.g., cross-linking between bases and/or covalently conjugating lipid to RNA (e.g., forming lipid-RNA adducts). This may, in some instances, lead to failure of a reverse transcriptase reaction and/or incorporation of inappropriate bases, e.g., at the site(s) of lesion(s), e.g., a mutation in a newly synthesized target DNA.

In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, a lipid nanoparticle formulation is produced using a lipid reagent comprising: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation is produced using a plurality of lipid reagents, and each lipid reagent of the plurality independently meets one or more criterion described in this paragraph. In some embodiments, each lipid reagent of the plurality meets the same criterion, e.g., a criterion of this paragraph.

In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation comprises: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, one or more, or optionally all, of the lipid reagents used for a lipid nanoparticle as described herein or a formulation thereof comprise: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, total aldehyde content and/or quantity of any single reactive impurity (e.g., aldehyde) species is determined by liquid chromatography (LC), e.g., coupled with tandem mass spectrometry (MS/MS), e.g., according to the method described in Example 40 of PCT/US21/20948. In some embodiments, reactive impurity (e.g., aldehyde) content and/or quantity of reactive impurity (e.g., aldehyde) species is determined by detecting one or more chemical modifications of a nucleic acid molecule (e.g., an RNA molecule, e.g., as described herein) associated with the presence of reactive impurities (e.g., aldehydes), e.g., in the lipid reagents. In some embodiments, reactive impurity (e.g., aldehyde) content and/or quantity of reactive impurity (e.g., aldehyde) species is determined by detecting one or more chemical modifications of a nucleotide or nucleoside (e.g., a ribonucleotide or ribonucleoside, e.g., comprised in or isolated from a template nucleic acid, e.g., as described herein) associated with the presence of reactive impurities (e.g., aldehydes), e.g., in the lipid reagents, e.g., according to the method described in Example 41 of PCT/US21/20948. In embodiments, chemical modifications of a nucleic acid molecule, nucleotide, or nucleoside are detected by determining the presence of one or more modified nucleotides or nucleosides, e.g., using LC-MS/MS analysis, e.g., according to the method described in Example 41 of PCT/US21/20948.

In some embodiments, a nucleic acid (e.g., RNA) described herein (e.g., a template nucleic acid or a nucleic acid encoding a gene modifying polypeptide) does not comprise an aldehyde modification, or comprises less than a preselected amount of aldehyde modifications. In some embodiments, on average, a nucleic acid has less than 50, 20, 10, 5, 2, or 1 aldehyde modifications per 1000 nucleotides, e.g., wherein a single cross-linking of two nucleotides is a single aldehyde modification. In some embodiments, the aldehyde modification is an RNA adduct (e.g., a lipid-RNA adduct). In some embodiments, the aldehyde-modified nucleotide is cross-linking between bases. In some embodiments, a nucleic acid (e.g., RNA) described herein comprises less than 50, 20, 10, 5, 2, or 1 cross-links between nucleotide.

Figure 6:
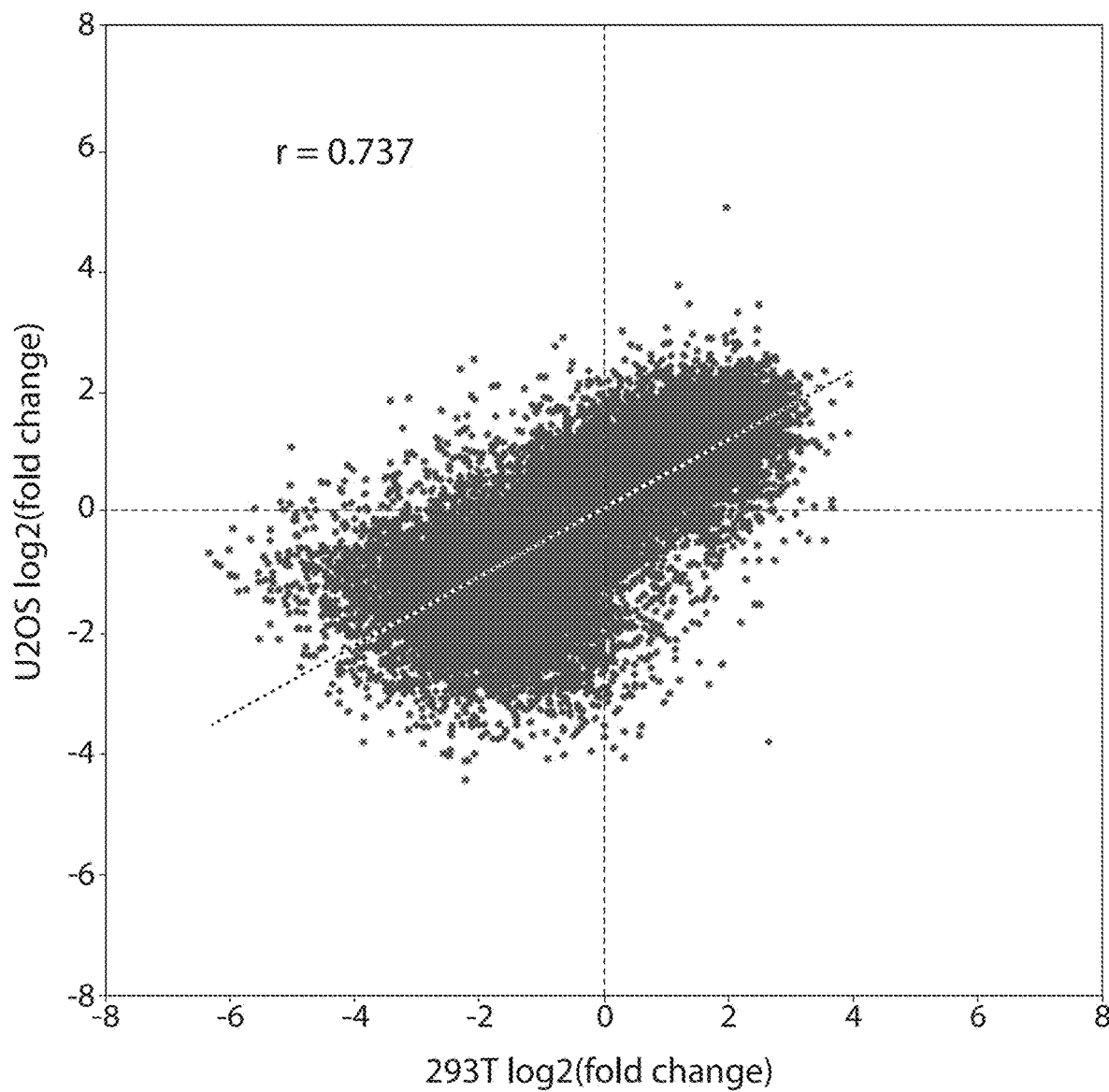
FIG. 6 shows a graph of enrichment of exemplary gene modifying polypeptides when editing activity was tested in HEK293T cells (X-axis) or in U2OS cells (Y-axis). A linear regression line is plotted based upon the scatter plot data.

In some embodiments, LNPs are directed to specific tissues by the addition of targeting domains. For example, biological ligands may be displayed on the surface of LNPs to enhance interaction with cells displaying cognate receptors, thus driving association with and cargo delivery to tissues wherein cells express the receptor. In some embodiments, the biological ligand may be a ligand that drives delivery to the liver, e.g., LNPs that display GalNAc result in delivery of nucleic acid cargo to hepatocytes that display asialoglycoprotein receptor (ASGPR). The work of Akinc et al. Mol Ther 18(7):1357-1364 (2010) teaches the conjugation of a trivalent GalNAc ligand to a PEG-lipid (GalNAc-PEG-DSG) to yield LNPs dependent on ASGPR for observable LNP cargo effect (see, e.g., FIG. 6 therein). Other ligand-displaying LNP formulations, e.g., incorporating folate, transferrin, or antibodies, are discussed in WO2017223135, which is incorporated herein by reference in its entirety, in addition to the references used therein, namely Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; and Peer and Lieberman, Gene Ther. 2011 18:1127-1133.

In some embodiments, LNPs are selected for tissue-specific activity by the addition of a Selective ORgan Targeting (SORT) molecule to a formulation comprising traditional components, such as ionizable cationic lipids, amphipathic phospholipids, cholesterol and poly(ethylene glycol) (PEG) lipids. The teachings of Cheng et al. Nat Nanotechnol 15(4):313-320 (2020) demonstrate that the addition of a supplemental "SORT" component precisely alters the in vivo RNA delivery profile and mediates tissue-specific (e.g., lungs, liver, spleen) gene delivery and editing as a function of the percentage and biophysical property of the SORT molecule.

In some embodiments, the LNPs comprise biodegradable, ionizable lipids. In some embodiments, the LNPs comprise (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl) propyl (9Z,12Z)-octadeca-9,12-dienoate) or another ionizable lipid. See, e.g, lipids of WO2019/067992, WO/2017/173054, WO2015/095340, and WO2014/136086, as well as references provided therein. In some embodiments, the term cationic and ionizable in the context of LNP lipids is interchangeable, e.g., wherein ionizable lipids are cationic depending on the pH.

In some embodiments, an LNP described herein comprises a lipid described in Table 19

TABLE 19

Exemplary lipids

| LIPID ID | Chemical Name | Molecular Weight | Structure |
|---|---|---|---|
| LIPIDV003 | (9Z,12Z)-3-((4,4-bis(octyloxy)butanoyl)oxy)-2-((((3-(diethylamino)propoxy)carbonyl)oxy)methyl)propyl octadeca-9,12-dienoate | 852.29 | 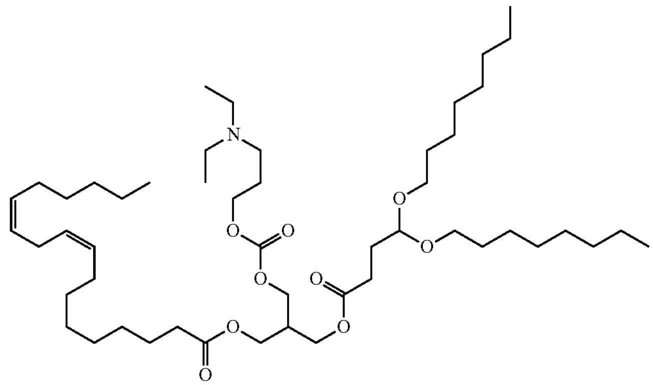 [SMILES: CCCCC/C=C\C/C=C\CCCCCCCC(=O)OCC(COC(=O)CCC(OCCCCCCCC)OCCCCCCCC)COC(=O)OCCCN(CC)CC] |
| LIPIDV004 | Heptadecan-9-yl 8-((2-hydroxyethyl)(8-(nonyloxy)-8-oxooctyl)amino)octanoate | 710.18 | 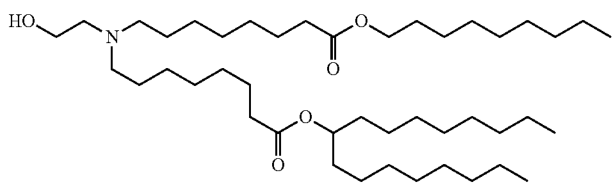 [SMILES: CCCCCCCCCOC(=O)CCCCCCCN(CCO)CCCCCCCC(=O)OC(CCCCCCCC)CCCCCCCC] |
| LIPIDV005 | | 919.56 | 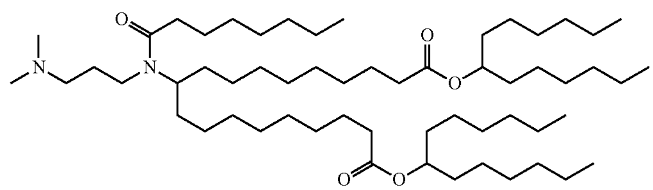 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] |

In some embodiments, multiple components of a gene modifying system may be prepared as a single LNP formulation, e.g., an LNP formulation comprises mRNA encoding for the gene modifying polypeptide and an RNA template. Ratios of nucleic acid components may be varied in order to maximize the properties of a therapeutic. In some embodiments, the ratio of RNA template to mRNA encoding a gene modifying polypeptide is about 1:1 to 100:1, e.g., about 1:1 to 20:1, about 20:1 to 40:1, about 40:1 to 60:1, about 60:1 to 80:1, or about 80:1 to 100:1, by molar ratio. In other embodiments, a system of multiple nucleic acids may be prepared by separate formulations, e.g., one LNP formulation comprising a template RNA and a second LNP formulation comprising an mRNA encoding a gene modifying polypeptide. In some embodiments, the system may comprise more than two nucleic acid components formulated into LNPs. In some embodiments, the system may comprise a protein, e.g., a gene modifying polypeptide, and a template RNA formulated into at least one LNP formulation.

In some embodiments, the average LNP diameter of the LNP formulation may be between 10s of nm and 100s of nm, e.g., measured by dynamic light scattering (DLS). In some embodiments, the average LNP diameter of the LNP formulation may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the average LNP diameter of the LNP formulation may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 n, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In some embodiments, the average LNP diameter of the LNP formulation may be from about 70 nm to about 100 nm. In a particular embodiment, the average LNP diameter of the LNP formulation may be about 80 nm. In some embodiments, the average LNP diameter of the LNP formulation may be about 100 nm. In some embodiments, the average LNP diameter of the LNP formulation ranges from about 1 mm to about 500 mm, from about 5 mm to about 200 mm, from about 10 mm to about 100 mm, from about 20 mm to about 80 mm, from about 25 mm to about 60 mm, from about 30 mm to about 55 mm, from about 35 mm to about 50 mm, or from about 38 mm to about 42 mm.

An LNP may, in some instances, be relatively homogenous. A polydispersity index may be used to indicate the homogeneity of an LNP, e.g., the particle size distribution of the lipid nanoparticles. A small (e.g., less than 0.3) polydispersity index generally indicates a narrow particle size distribution. An LNP may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of an LNP may be from about 0.10 to about 0.20.

The zeta potential of an LNP may be used to indicate the electrokinetic potential of the composition. In some embodiments, the zeta potential may describe the surface charge of an LNP. Lipid nanoparticles with relatively low charges, positive or negative, are generally desirable, as more highly charged species may interact undesirably with cells, tissues, and other elements in the body. In some embodiments, the zeta potential of an LNP may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

The efficiency of encapsulation of a protein and/or nucleic acid, e.g., gene modifying polypeptide or mRNA encoding the polypeptide, describes the amount of protein and/or nucleic acid that is encapsulated or otherwise associated with an LNP after preparation, relative to the initial amount provided. The encapsulation efficiency is desirably high (e.g., close to 100%). The encapsulation efficiency may be measured, for example, by comparing the amount of protein or nucleic acid in a solution containing the lipid nanoparticle before and after breaking up the lipid nanoparticle with one or more organic solvents or detergents. An anion exchange resin may be used to measure the amount of free protein or nucleic acid (e.g., RNA) in a solution. Fluorescence may be used to measure the amount of free protein and/or nucleic acid (e.g., RNA) in a solution. For the lipid nanoparticles described herein, the encapsulation efficiency of a protein and/or nucleic acid may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In some embodiments, the encapsulation efficiency may be at least 90%. In some embodiments, the encapsulation efficiency may be at least 95%.

An LNP may optionally comprise one or more coatings. In some embodiments, an LNP may be formulated in a capsule, film, or table having a coating. A capsule, film, or tablet including a composition described herein may have any useful size, tensile strength, hardness or density.

Additional exemplary lipids, formulations, methods, and characterization of LNPs are taught by WO2020061457, which is incorporated herein by reference in its entirety.

In some embodiments, in vitro or ex vivo cell lipofections are performed using Lipofectamine MessengerMax (Thermo Fisher) or TransIT-mRNA Transfection Reagent (Mirus Bio). In certain embodiments, LNPs are formulated using the GenVoy_ILM ionizable lipid mix (Precision NanoSystems). In certain embodiments, LNPs are formulated using 2,2-dilinoleyl-4-dimethylaminoethyl-[1,3]-dioxolane (DLin-KC2-DMA) or dilinoleylmethyl-4-dimethylaminobutyrate (DLin-MC3-DMA or MC3), the formulation and in vivo use of which are taught in Jayaraman et al. Angew Chem Int Ed Engl 51(34):8529-8533 (2012), incorporated herein by reference in its entirety.

LNP formulations optimized for the delivery of CRISPR-Cas systems, e.g., Cas9-gRNA RNP, gRNA, Cas9 mRNA, are described in WO2019067992 and WO2019067910, both incorporated by reference.

Additional specific LNP formulations useful for delivery of nucleic acids are described in U.S. Pat. Nos. 8,158,601 and 8,168,775, both incorporated by reference, which include formulations used in patisiran, sold under the name ONPATTRO.

Exemplary dosing of gene modifying LNP may include about 0.1, 0.25, 0.3, 0.5, 1, 2, 3, 4, 5, 6, 8, 10, or 100 mg/kg (RNA). Exemplary dosing of AAV comprising a nucleic acid encoding one or more components of the system may include an MOI of about $10^{11}$, $10^{12}$, $10^{13}$, and $10^{14}$ vg/kg.

Kits, Articles of Manufacture, and Pharmaceutical Compositions

In an aspect the disclosure provides a kit comprising a gene modifying polypeptide or a gene modifying system, e.g., as described herein. In some embodiments, the kit comprises a gene modifying polypeptide (or a nucleic acid encoding the polypeptide) and a template RNA (or DNA encoding the template RNA). In some embodiments, the kit further comprises a reagent for introducing the system into a cell, e.g., transfection reagent, LNP, and the like. In some embodiments, the kit is suitable for any of the methods described herein. In some embodiments, the kit comprises one or more elements, compositions (e.g., pharmaceutical compositions), gene modifying polypeptides, and/or gene modifying systems, or a functional fragment or component thereof, e.g., disposed in an article of manufacture. In some embodiments, the kit comprises instructions for use thereof.

In an aspect, the disclosure provides an article of manufacture, e.g., in which a kit as described herein, or a component thereof, is disposed.

In an aspect, the disclosure provides a pharmaceutical composition comprising a gene modifying polypeptide or a gene modifying system, e.g., as described herein. In some embodiments, the pharmaceutical composition further comprises a pharmaceutically acceptable carrier or excipient. In some embodiments, the pharmaceutical composition comprises a template RNA and/or an RNA encoding the polypeptide. In embodiments, the pharmaceutical composition has one or more (e.g., 1, 2, 3, or 4) of the following characteristics:
 (a) less than 1% (e.g., less than 0.5%, 0.4%, 0.3%, 0.2%, or 0.1%) DNA template relative to the template RNA and/or the RNA encoding the polypeptide, e.g., on a molar basis;
 (b) less than 1% (e.g., less than 0.5%, 0.4%, 0.3%, 0.2%, or 0.1%) uncapped RNA relative to the template RNA and/or the RNA encoding the polypeptide, e.g., on a molar basis;
 (c) less than 1% (e.g., less than 0.5%, 0.4%, 0.3%, 0.2%, or 0.1%) partial length RNAs relative to the template RNA and/or the RNA encoding the polypeptide, e.g., on a molar basis;
 (d) substantially lacks unreacted cap dinucleotides.

Chemistry, Manufacturing, and Controls (CMC)

Purification of protein therapeutics is described, for example, in Franks, Protein Biotechnology: *Isolation, Characterization, and Stabilization*, Humana Press (2013); and in Cutler, *Protein Purification Protocols* (*Methods in Molecular Biology*), Humana Press (2010).

In some embodiments, a gene modifying system, polypeptide, and/or template nucleic acid (e.g., template RNA) conforms to certain quality standards. In some embodiments, a gene modifying system, polypeptide, and/or template nucleic acid (e.g., template RNA) produced by a method described herein conforms to certain quality standards. Accordingly, the disclosure is directed, in some aspects, to methods of manufacturing a gene modifying system, polypeptide, and/or template nucleic acid (e.g., template RNA) that conforms to certain quality standards, e.g., in which said quality standards are assayed. The disclosure is also directed, in some aspects, to methods of assaying said quality standards in a gene modifying system, polypeptide, and/or template nucleic acid (e.g., template RNA). In some embodiments, quality standards include, but are not limited to, one or more (e.g., 1, 2, 3, 4, 5, 6, 7, 8, 9, 10, 11, or 12) of the following:

(i) the length of the template RNA, e.g., whether the template RNA has a length that is above a reference length or within a reference length range, e.g., whether at least 80%, 85%, 90%, 95%, 96%, 97%, 98%, or 99% of the template RNA present is greater than 100, 125, 150, 175, or 200 nucleotides long;

(ii) the presence, absence, and/or length of a polyA tail on the template RNA, e.g., whether at least 80%, 85%, 90%, 95%, 96%, 97%, 98%, or 99% of the template RNA present contains a polyA tail (e.g., a polyA tail that is at least 5, 10, 20, 30, 50, 70, 100 nucleotides in length (SEQ ID NO: 15471));

(iii) the presence, absence, and/or type of a 5' cap on the template RNA, e.g., whether at least 80%, 85%, 90%, 95%, 96%, 97%, 98%, or 99% of the template RNA present contains a 5' cap, e.g., whether that cap is a 7-methylguanosine cap, e.g., a O-Me-m7G cap;

(iv) the presence, absence, and/or type of one or more modified nucleotides (e.g., selected from pseudouridine, dihydrouridine, inosine, 7-methylguanosine, 1-N-methylpseudouridine (1-Me-t), 5-methoxyuridine (5-MO-U), 5-methylcytidine (5mC), or a locked nucleotide) in the template RNA, e.g., whether at least 80%, 85%, 90%, 95%, 96%, 97%, 98%, or 99% of the template RNA present contains one or more modified nucleotides;

(v) the stability of the template RNA (e.g., over time and/or under a pre-selected condition), e.g., whether at least 80%, 85%, 90%, 95%, 96%, 97%, 98%, or 99% of the template RNA remains intact (e.g., greater than 100, 125, 150, 175, or 200 nucleotides long) after a stability test;

(vi) the potency of the template RNA in a system for modifying DNA, e.g., whether at least 1% of target sites are modified after a system comprising the template RNA is assayed for potency;

(vii) the length of the polypeptide, first polypeptide, or second polypeptide, e.g., whether the polypeptide, first polypeptide, or second polypeptide has a length that is above a reference length or within a reference length range, e.g., whether at least 80%, 85%, 90%, 95%, 96%, 97%, 98%, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);

(viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation, or any combination thereof;

(ix) the presence, absence, and/or type of one or more artificial, synthetic, or non-canonical amino acids (e.g., selected from ornithine, β-alanine, GABA, δ-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenoethionine, tellurocysteine, or telluromethionine) in the polypeptide, first polypeptide, or second polypeptide, e.g., whether at least 80%, 85%, 90%, 95%, 96%, 97%, 98%, or 99% of the polypeptide, first polypeptide, or second polypeptide present contains one or more artificial, synthetic, or non-canonical amino acids;

(x) the stability of the polypeptide, first polypeptide, or second polypeptide (e.g., over time and/or under a pre-selected condition), e.g., whether at least 80%, 85%, 90%, 95%, 96%, 97%, 98%, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;

(xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or (xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

In some embodiments, a system or pharmaceutical composition described herein is endotoxin free.

In some embodiments, the presence, absence, and/or level of one or more of a pyrogen, virus, fungus, bacterial pathogen, and/or host cell protein is determined. In embodiments, whether the system is free or substantially free of pyrogen, virus, fungus, bacterial pathogen, and/or host cell protein contamination is determined.

In some embodiments, a pharmaceutical composition or system as described herein has one or more (e.g., 1, 2, 3, or 4) of the following characteristics:

(a) less than 1% (e.g., less than 0.5%, 0.4%, 0.3%, 0.2%, or 0.1%) DNA template relative to the template RNA and/or the RNA encoding the polypeptide, e.g., on a molar basis;

(b) less than 1% (e.g., less than 0.5%, 0.4%, 0.3%, 0.2%, or 0.1%) uncapped RNA relative to the template RNA and/or the RNA encoding the polypeptide, e.g., on a molar basis;

(c) less than 1% (e.g., less than 0.5%, 0.4%, 0.3%, 0.2%, or 0.1%) partial length RNAs relative to the template RNA and/or the RNA encoding the polypeptide, e.g., on a molar basis;

(d) substantially lacks unreacted cap dinucleotides.

EXAMPLES

Example 1: Quantifying Activity of a Gene Editing Polypeptide Using a GFP/BFP Assay in Human Cells This example describes the use of gene modifying system containing an exemplary gene modifying polypeptide and an exemplary template RNA. In this example, the template RNA contains:
(1) a gRNA spacer;
(2) a gRNA scaffold;
(3) a heterologous object sequence; and
(4) a primer binding site (PBS) sequence.
More specifically, the template RNA comprises the following sequence:

(SEQ ID NO: 11,010)
GCCGAAGCACTGCACGCCGTGTTTTAGAGCTAGAAATAGCAAGTTAAAA
TAAGGCTAGTCCGTTATCAACTTGAAAAAGTGGCACCGAGTCGGTGCAC
CCTGACGTACGGCGTGCAGTGCTT.

A gene modifying system comprising a given gene modifying polypeptide (e.g., one described herein) and the template RNA is transfected into the HEK293T BFP-expressing cell line. The gene modifying polypeptide and the template RNA are delivered by nucleofection in DNA format. Specifically, 800 ng of gene modifying polypeptide plasmid DNA is combined with 200 ng template RNA in plasmid format. The modifying polypeptide and template RNA in plasmid DNA format are added to 25 µL SF buffer containing 250,000 HEK293T BFP-expressing cells, and cells are nucleofected using program DS-150. After nucleofection, cells are grown at 37° C., 5% $CO_2$ for 3 days prior to cell lysis and genomic DNA extraction. To analyze gene editing activity, primers flanking the BFP locus can be used to amplify across the locus. Amplicons are analyzed via short read sequencing using an Illumina MiSeq. Conversion of the BFP gene sequence to the GFP gene sequence indicate successful editing. In some embodiments, the assay will indicate that at least 10%, 20%, 30%, 40%, 50%, 60%, or 70% of copies of the BFP gene in the sample are converted to the GFP gene.

Example 2: Gene Modifying Polypeptide Selection by Pooled Screening in HEK293T & U2OS Cells This example describes the use of an RNA gene modifying system for the targeted editing of a coding sequence in the human genome. More specifically, this example describes the infection of HEK293T and U2OS cells with a library of gene modifying candidates, followed by transfection of a template guide RNA (tgRNA) for in vitro gene modifying in the cells, e.g., as a means of evaluating a new gene modifying polypeptide for editing activity in human cells by a pooled screening approach.

Figure 2A:
FIGS. 2A-2B provide schematics of a gene modifying polypeptide candidate for a screening library and a description of the screening methodology.
Figure 2B:
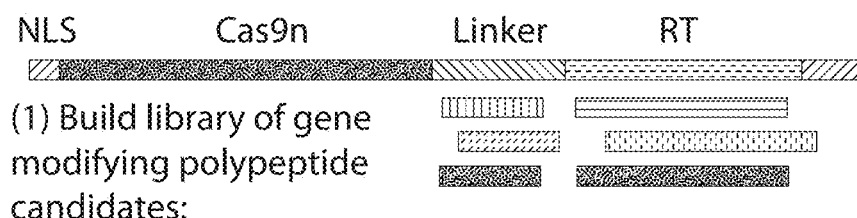
Figure 2B:

The gene modifying polypeptide library candidates assayed herein each comprise: 1) a *Streptococcus pyogenes* (*S. pyogenes*; Spy) Cas9 nickase containing an N863A mutation that inactivates one endonuclease active site; 2) one of the 122 peptide linkers depicted at Table 10; and 3) a reverse transcriptase (RT) domain from Table 6 of retroviral origin. The particular retroviral RT domains utilized were selected if they were expected to function as a monomer. For each selected RT domain, the wild-type sequences were tested, as well as versions with point mutations installed in the primary wild-type sequence. In particular, 143 RT domains were tested, either wild type or containing various mutations, based on exemplary RT domains listed in Table 2 (FIG. 2A). In total, 17,446 Cas-linker-RT gene modifying polypeptides (also referred to, in the context of the experiment, as individual elements or candidates) were tested. RT domains of the present disclosure can be grouped into families (each an "RT family"), each RT family comprising a wild type or reference RT sequence from a retrovirus and any variants of that RT wild type or reference sequence, e.g., RT sequences comprising one or more amino acid differences relative to the reference RT sequence. RT family candidates, accordingly, as used herein, refers to all gene modifying polypeptide candidates as described above, in which the RT sequence is selected from identified RT family.

The system described here is a two-component system comprising: 1) an expression plasmid encoding a human codon-optimized gene modifying polypeptide library candidate within a lentiviral cassette, and 2) a tgRNA expression plasmid expressing a non-coding tgRNA sequence that is recognized by Cas and localizes it to the genomic locus of interest, and that also templates reverse transcription of the desired edit into the genome by the RT domain, driven by a U6 promoter. The lentiviral cassette comprises: (i) a CMV promoter for expression in mammalian cells; (ii) a gene modifying polypeptide library candidate as shown; (iii) a self-cleaving T2A polypeptide; (iv) a puromycin resistance gene enabling selection in mammalian cells; and (v) a polyA tail termination signal.

To prepare a pool of cells expressing gene modifying polypeptide library candidates, HEK293T or U2OS cells were transduced with pooled lentiviral preparations of the gene modifying candidate plasmid library. HEK293 Lenti-X cells were seeded in 15 cm plates ($12\times10^6$ cells) prior to lentiviral plasmid transfection. Lentiviral plasmid transfection using the Lentiviral Packaging Mix (Biosettia, 27 ug) and the plasmid DNA for the gene modifying candidate library (27 ug) was performed the following day using Lipofectamine 2000 and Opti-MEM media according to the manufacturer's protocol. Extracellular DNA was removed by a full media change the next day and virus-containing media was harvested 48 hours after. Lentiviral media was concentrated using Lenti-X Concentrator (TaKaRa Biosciences) and 5 mL lentiviral aliquots were made and stored at −80° C. Lentiviral titering was performed by enumerating colony forming units post Puromycin selection. HEK293T or U2OS cells carrying a BFP-expressing genomic landing pad were seeded at $6\times10^7$ cells in culture plates and transduced at a 0.3 multiplicity of infection (MOI) to minimize multiple infections per cell. Puromycin (2.5 ug/mL) was added 48 hours post infection to allow for selection of infected cells. Cells were kept under puromycin selection for at least 7 days and then scaled up for tgRNA electroporation.

To determine the genome-editing capacity of the gene modifying library candidates in the assay, infected BFP-expressing HEK293T or U2OS cells were then transfected by electroporation of 250,000 cells/well with 200 ng of a tgRNA (either g4 or g10) plasmid, designed to convert BFP to GFP, at sufficient cell count for >1000× coverage per library candidate.

The g4 tgRNA (5' to 3') is as follows: 20 nucleotide spacer region (GCCGAAGCACTGCACGCCGT; SEQ ID NO: 11,011), a scaffold region (GTTT-TAGAGCTAGAAATAGCAAGT-TAAAATAAGGCTAGTCCGTTATCAACTT-GAAAAAGTG GCACCGAGTCGGTGC; SEQ ID NO: 11,012), the template region encoding the single base pair substitution to change BFP to GFP (bold) and a PAM inactivation that introduces a synonymous point mutation in the SpyCas9 PAM (NGG to NCG) that prevents re-engagement of the gene modifying polypeptide upon completion of a functional gene modifying reaction (underline) (ACCCTGACGTACG; SEQ ID NO: 11,013), and the 13 nucleotide PBS (GCGTGCAGTGCTT; SEQ ID NO: 11,014).

Similarly, the g10 tgRNA (5' to 3') is as follows: 20 nucleotide spacer region (AGAAGTCGTGCTGCTTCATG; SEQ ID NO: 11,015), a scaffold region (GTTTTAGAGCTAGAAATAGCAAGT-TAAAATAAGGCTAGTCCGTTATCAACTTGAAAAAGTG GCACCGAGTCGGTGC; SEQ ID NO: 11,016), the template region encoding the single base pair substitution to change BFP to GFP (bold) and a PAM inactivation that introduces a synonymous point mutation in the SpyCas9 PAM (NGG to NGA) that prevents re-engagement of the gene modifying polypeptide upon completion of a functional gene modifying reaction (underline) (ACCCTGACCTACGGCGTGCAGTGCTTCGGCCGC-TACCCCGATCACAT; SEQ ID NO: 11,017), and 13 nucleotide PBS (GAAGCAGCACGAC; SEQ ID NO: 11,018).

Figure 3:
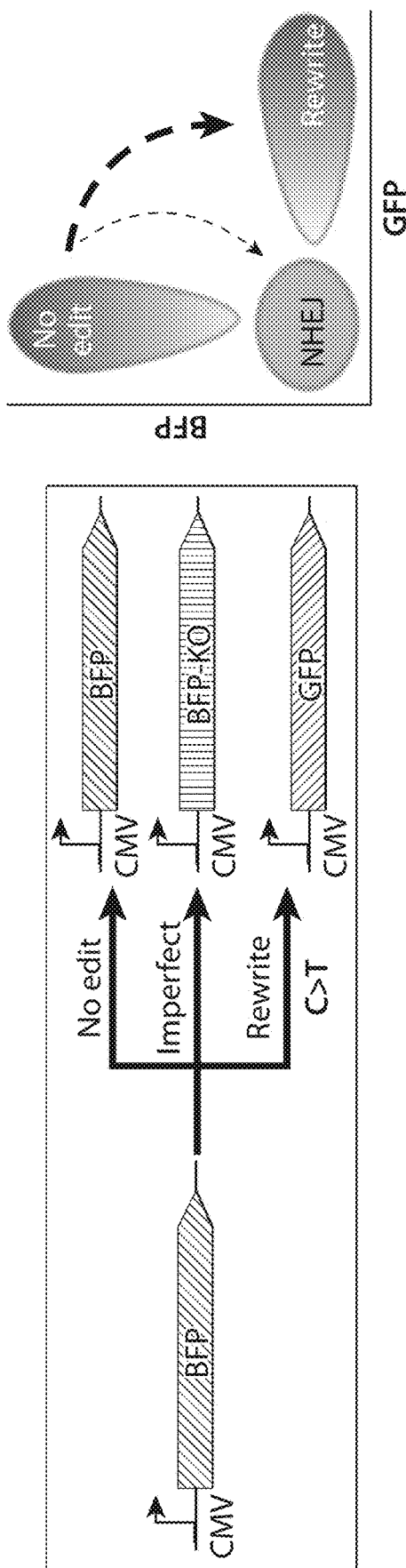
FIG. 3 provides a schematic of an assay for detecting gene editing, including the target reporter gene (BFP) in the test cell line and the three outcomes in the assay depending on whether there is no edit, an imperfect edit, or a perfect edit of a C to a T, resulting in expression and detecting of GFP rather than BFP.

To assess the genome-editing capacity of the various constructs in the assay, cells were sorted by Fluorescence-Activated Cell Sorting (FACS) for GFP expression 6-7 days post-electroporation. Cells were sorted and harvested as distinct populations of unedited (BFP+) cells, edited (GFP+) cells and imperfect edit (BFP-, GFP-) cells (FIG. 3). A sample of unsorted cells was also harvested as the input population to determine enrichment during analysis.

To determine which gene modifying library candidates have genome-editing capacity in this assay, genomic DNA (gDNA) was harvested from sorted and unsorted cell populations, and analyzed by sequencing the gene modifying library candidates in each population. Briefly, gene modifying sequences were amplified from the genome using primers specific to the lentiviral cassette, amplified in a second round of PCR to dilute genomic DNA, and then sequenced using Oxford Nanopore Sequencing Technology according to the manufacturer's protocol.

After quality control of sequencing reads, reads of at least 1500 and no more than 3200 nucleotides were mapped to the gene modifying polypeptide library sequences and those containing a minimum of an 80% match to a library sequence were considered to be successfully aligned to a given candidate. To identify gene modifying candidates capable of performing gene editing in the assay, the read count of each library candidate in the edited population was compared to its read count in the initial, unsorted population. For purposes of this pooled screen, gene modifying candidates with genome-editing capacity were selected as those candidates that were enriched in the converted (GFP±) population relative to unsorted (input) cells and wherein the enrichment was determined to be at or above the enrichment level of a reference (Element ID No: 17380 as listed in Example 7).

A large number of gene modifying polypeptide candidates were determined to be enriched in the GFP± cell populations. For example, of the 17,446 candidates tested, over 3,300 exhibited enrichment in GFP± sorted populations (relative to unsorted) that was at least equivalent to that of the reference under similar experimental conditions (HEK293T using g4 tgRNA; HEK293T cells using g10 tgRNA; or U2OS cells using g4 tgRNA), shown in Table 1. Although the 17,446 candidates were also tested in U2OS cells using g10 tgRNA, the pooled screen did not yield candidates that were enriched in the converted (GFP±) population relative to unsorted (input) cells under that experimental condition. A subset of the gene modifying polypeptide candidates tested were selected for further analysis (amino acid sequences listed Table A1).

TABLE 1

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKGSS | 12,001 | PERV_Q4VFZ2_3mutA_WS |
| EAAAKEAAAKEAAAKEAAAK | 12,002 | MLVMS_P03355_PLV919 |
| PAPEAAAK | 12,003 | MLVFF_P26809_3mutA |
| EAAAKPAPGGG | 12,004 | MLVFF_P26809_3mutA |
| GSSGSSGSSGSSGSSGSS | 12,005 | PERV_Q4VFZ2_3mut |
| PAPGGGEAAAK | 12,006 | MLVAV_P03356_3mutA |
| AEAAAKEAAAKEAAAKEAAAKALEAEAAAKEAAAKEAAAKEAAAKA | 12,007 | MLVMS_P03355_PLV919 |
| GSSEAAAK | 12,008 | MLVFF_P26809_3mutA |
| EAAAKPAPGGS | 12,009 | MLVFF_P26809_3mutA |
| GGSGGSGGSGGSGGSGGS | 12,010 | MLVFF_P26809_3mutA |
| AEAAAKEAAAKEAAAKEAAAKALEAEAAAKEAAAKEAAAKEAAAKA | 12,011 | XMRV6_A1Z651_3mutA |
| AEAAAKEAAAKEAAAKEAAAKALEAEAAAKEAAAKEAAAKEAAAKA | 12,012 | PERV_Q4VFZ2_3mutA_WS |
| EAAAKEAAAKEAAAK | 12,013 | MLVFF_P26809_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPEAAAKGSS | 12,014 | MLVFF_P26809_3mutA |
| AEAAAKEAAAKEAAAKEAAAKALEAEAAAKEAAAKEAAAKEAAAKA | 12,015 | PERV_Q4VFZ2_3mutA_WS |
| EAAAKEAAAKEAAAK | 12,016 | PERV_Q4VFZ2_3mutA_WS |
| AEAAAKEAAAKEAAAKEAAAKALEAEAAAKEAAAKEAAAKEAAAKA | 12,017 | AVIRE_P03360_3mutA |
| PAPAPAPAPAP | 12,018 | MLVCB_P08361_3mutA |
| PAPAPAPAPAP | 12,019 | MLVFF_P26809_3mutA |
| EAAAKGGSPAP | 12,020 | PERV_Q4VFZ2_3mutA_WS |
| PAP | | MLVMS_P03355_PLV919 |
| PAPGGGGSS | 12,022 | WMSV_P03359_3mutA |
| SGSETPGTSESATPES | 12,023 | MLVFF_P26809_3mutA |
| PAPEAAAKGSS | 12,024 | XMRV6_A1Z651_3mutA |
| EAAAKGGSGGG | 12,025 | MLVMS_P03355_PLV919 |
| GGGGSGGGGS | 12,026 | MLVFF_P26809_3mutA |
| GGGPAPGSS | 12,027 | MLVAV_P03356_3mutA |
| GGSGGSGGSGGSGGSGGS | 12,028 | XMRV6_A1Z651_3mut |
| GGGGSGGGGSGGGGSGGGGSGGGGSGGGGS | 12,029 | MLVCB_P08361_3mutA |
| GSSPAP | 12,030 | AVIRE_P03360_3mutA |
| EAAAKGSSPAP | 12,031 | MLVFF_P26809_3mutA |
| GSSGGGEAAAK | 12,032 | MLVFF_P26809_3mutA |
| GGSGGSGGSGGSGGSGGS | 12,033 | MLVMS_P03355_3mutA_WS |
| PAPAPAPAP | 12,034 | MLVFF_P26809_3mutA |
| EAAAKEAAAKEAAAKEAAAK | 12,035 | XMRV6_A1Z651_3mutA |
| EAAAKGGSPAP | 12,036 | MLVMS_P03355_3mutA_WS |
| PAPGGSEAAAK | 12,037 | AVIRE_P03360_3mutA |
| GGGGSGGGGSGGGGSGGGGSGGGGSGGGGS | 12,038 | AVIRE_P03360_3mutA |
| EAAAKGGGGSEAAAK | 12,039 | MLVCB_P08361_3mutA |
| AEAAAKEAAAKEAAAKEAAAKALEAEAAAKEAAAKEAAAKEAAAKA | 12,040 | WMSV_P03359_3mutA |
| GSS | | MLVMS_P03355_PLV919 |
| GSSGSSGSSGSS | 12,042 | MLVMS_P03355_PLV919 |
| GSSPAPEAAAK | 12,043 | XMRV6_A1Z651_3mutA |
| GGSPAPEAAAK | 12,044 | MLVFF_P26809_3mutA |
| GGGEAAAKGGS | 12,045 | MLVFF_P26809_3mutA |
| EAAAKEAAAKEAAAKEAAAKEAAAK | 12,046 | PERV_Q4VFZ2_3mutA_WS |
| GGGGGGGG | 12,047 | PERV_Q4VFZ2_3mut |
| GGGPAP | 12,048 | MLVCB_P08361_3mutA |
| PAPAPAPAPAPAP | 12,049 | MLVCB_P08361_3mutA |
| GGSGGSGGSGGSGGSGGS | 12,050 | MLVCB_P08361_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAP | | MLVMS_P03355_3mutA_WS |
| GGSGGSGGSGGSGGSGGS | 12,052 | PERV_Q4VFZ2_3mutA_WS |
| PAPAPAPAPAPAP | 12,053 | MLVMS_P03355_PLV919 |
| EAAAKPAPGSS | 12,054 | MLVMS_P03355_3mutA_WS |
| EAAAKEAAAKEAAAKEAAAK | 12,055 | MLVMS_P03355_3mutA_WS |
| EAAAKGGS | 12,056 | MLVMS_P03355_3mutA_WS |
| GGGGSEAAAKGGGGS | 12,057 | MLVFF_P26809_3mutA |
| EAAAKPAPGSS | 12,058 | MLVFF_P26809_3mutA |
| GGGGSGGGGSGGGGSGGGGS | 12,059 | MLVMS_P03355_PLV919 |
| EAAAKGGGGS | 12,060 | MLVMS_P03355_PLV919 |
| GGSPAP | 12,061 | XMRV6_A1Z651_3mutA |
| EAAAKGGGPAP | 12,062 | MLVMS_P03355_PLV919 |
| EAAAKEAAAKEAAAKEAAAKEAAAK | 12,063 | MLVFF_P26809_3mutA |
| PAP | | MLVCB_P08361_3mutA |
| EAAAK | 12,065 | XMRV6_A1Z651_3mutA |
| GGSGSSPAP | 12,066 | PERV_Q4VFZ2_3mutA_WS |
| GSSGSSGSSGSSGSSGSS | 12,067 | MLVMS_P03355_PLV919 |
| GSSEAAAKGGG | 12,068 | MLVAV_P03356_3mutA |
| GGGEAAAKGGS | 12,069 | XMRV6_A1Z651_3mutA |
| EAAAKGGGGSEAAAK | 12,070 | MLVAV_P03356_3mutA |
| GGGGSGGGGSGGGGS | 12,071 | MLVFF_P26809_3mutA |
| GGGGSGGGGSGGGGSGGGGS | 12,072 | AVIRE_P03360_3mutA |
| SGSETPGTSESATPES | 12,073 | AVIRE_P03360_3mutA |
| GGGEAAAKPAP | 12,074 | MLVFF_P26809_3mutA |
| EAAAKGSSGGG | 12,075 | MLVMS_P03355_3mutA_WS |
| EAAAKEAAAKEAAAKEAAAKEAAAK | 12,076 | WMSV_P03359_3mut |
| GGSGGSGGSGGS | 12,077 | XMRV6_A1Z651_3mutA |
| GGSEAAAKPAP | 12,078 | MLVFF_P26809_3mutA |
| EAAAKGSSGGG | 12,079 | XMRV6_A1Z651_3mutA |
| GGGGS | 12,080 | MLVFF_P26809_3mutA |
| GGGEAAAKGSS | 12,081 | MLVMS_P03355_PLV919 |
| PAPAPAPAPAPAP | 12,082 | MLVAV_P03356_3mutA |
| GGGGSGGGGSGGGGSGGGGS | 12,083 | MLVCB_P08361_3mutA |
| GGGEAAAKGSS | 12,084 | MLVCB_P08361_3mutA |
| PAPGGSGSS | 12,085 | MLVFF_P26809_3mutA |
| GSAGSAAGSGEF | 12,086 | MLVCB_P08361_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGGSEAAAK | 12,087 | MLVMS_P03355_3mutA_WS |
| GGSGSS | 12,088 | XMRV6_A1Z651_3mutA |
| PAPGGGGSS | 12,089 | MLVMS_P03355_PLV919 |
| GSSGSSGSS | 12,090 | XMRV6_A1Z651_3mut |
| AEAAAKEAAAKEAAAKEAAAKALEAEAAAKEAAAKEAAAKEAAAKA | 12,091 | MLVMS_P03355_3mutA_WS |
| EAAAK | 12,092 | MLVMS_P03355_PLV919 |
| GSSGSSGSSGSS | 12,093 | MLVFF_P26809_3mutA |
| PAPGGGGSS | 12,094 | MLVCB_P08361_3mutA |
| GGGEAAAKGGS | 12,095 | MLVCB_P08361_3mutA |
| PAPGGGEAAAK | 12,096 | MLVMS_P03355_PLV919 |
| GGGGGSPAP | 12,097 | XMRV6_A1Z651_3mutA |
| EAAAKGGS | 12,098 | XMRV6_A1Z651_3mutA |
| EAAAKGSSPAP | 12,099 | XMRV6_A1Z651_3mut |
| PAPEAAAK | 12,100 | MLVAV_P03356_3mutA |
| GGSGGSGGSGGS | 12,101 | MLVMS_P03355_3mutA_WS |
| GGGPAPGGS | 12,102 | MLVMS_P03355_PLV919 |
| GSSGSSGSSGSS | 12,103 | PERV_Q4VFZ2_3mutA_WS |
| EAAAKPAPGGS | 12,104 | MLVCB_P08361_3mutA |
| GSSGSS | 12,105 | MLVFF_P26809_3mutA |
| EAAAKEAAAKEAAAKEAAAK | 12,106 | MLVCB_P08361_3mutA |
| EAAAKEAAAKEAAAKEAAAK | 12,107 | FLV_P10273_3mutA |
| GSS | | MLVFF_P26809_3mutA |
| EAAAKEAAAK | 12,109 | MLVMS_P03355_3mutA_WS |
| PAPEAAAKGGG | 12,110 | MLVAV_P03356_3mutA |
| GGSGSSEAAAK | 12,111 | MLVFF_P26809_3mutA |
| EAAAKEAAAKEAAAKEAAAKEAAAK | 12,112 | PERV_Q4VFZ2 |
| GSSEAAAKPAP | 12,113 | AVIRE_P03360_3mutA |
| EAAAKEAAAKEAAAKEAAAKEAAAK | 12,114 | MLVCB_P08361_3mutA |
| EAAAKGGG | 12,115 | MLVFF_P26809_3mutA |
| GSSPAPGGG | 12,116 | MLVCB_P08361_3mutA |
| GGGPAPGSS | 12,117 | MLVMS_P03355_PLV919 |
| GGGGGS | 12,118 | MLVMS_P03355_3mutA_WS |
| EAAAKEAAAKEAAAKEAAAKEAAAK | 12,119 | PERV_Q4VFZ2_3mut |
| GGGGSGGGGSGGGGSGGGGSGGGGS | 12,120 | WMSV_P03359_3mutA |
| EAAAKEAAAKEAAAK | 12,121 | PERV_Q4VFZ2_3mut |
| PAPAPAPAP | 12,122 | MLVCB_P08361_3mutA |
| GSSGSSGSSGSSGSS | 12,123 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSSEAAAK | 12,124 | MLVMS_P03355_3mutA_WS |
| GGSGGSGGSGGS | 12,125 | MLVCB_P08361_3mutA |
| PAPEAAAKGGS | 12,126 | MLVCB_P08361_3mutA |
| EAAAKEAAAKEAAAKEAAAKEAAAK | 12,127 | MLVCB_P08361_3mutA |
| EAAAKGGGGSEAAAK | 12,128 | MLVMS_P03355_PLV919 |
| EAAAKGGGGSEAAAK | 12,129 | MLVMS_P03355_3mutA_WS |
| EAAAKGGGPAP | 12,130 | XMRV6_A1Z651_3mut |
| EAAAKEAAAKEAAAKEAAAK | 12,131 | MLVMS_P03355_3mutA_WS |
| AEAAAKEAAAKEAAAKEAAAKALEAEAAAKEAAAKEAAAKEAAAKA | 12,132 | FLV_P10273_3mutA |
| GGSEAAAKGGG | 12,133 | MLVMS_P03355_3mutA_WS |
| GGGGSGGGGSGGGGSGGGGSGGGGSGGGGS | 12,134 | KORV_Q9TTC1-Pro_3mutA |
| GGGPAPGGS | 12,135 | MLVCB_P08361_3mutA |
| PAPAPAPAPAPAP | 12,136 | XMRV6_A1Z651_3mut |
| GGSGSSGGG | 12,137 | XMRV6_A1Z651_3mut |
| GGSGSSGGG | 12,138 | MLVCB_P08361_3mutA |
| GGGEAAAKGGS | 12,139 | MLVMS_P03355_3mutA_WS |
| EAAAK | 12,140 | MLVCB_P08361_3mutA |
| GGSPAPGSS | 12,141 | MLVMS_P03355_3mutA_WS |
| GGGGSSEAAAK | 12,142 | PERV_Q4VFZ2_3mut |
| PAPAPAPAPAP | 12,143 | MLVBM_Q7SVK7_3mut |
| EAAAKEAAAKEAAAKEAAAK | 12,144 | MLVAV_P03356_3mutA |
| GGGGGSGSS | 12,145 | MLVCB_P08361_3mutA |
| EAAAKGSSPAP | 12,146 | MLVMS_P03355_3mutA_WS |
| PAPAPAPAPAP | 12,147 | MLVMS_P03355_3mutA_WS |
| GSSGGGGGS | 12,148 | MLVMS_P03355_3mutA_WS |
| PAPGSSGGG | 12,149 | MLVMS_P03355_PLV919 |
| GGSGGGPAP | 12,150 | MLVCB_P08361_3mutA |
| GGGGGGG | 12,151 | MLVCB_P08361_3mutA |
| GSSGSSGSSGSSGSSGSS | 12,152 | MLVCB_P08361_3mutA |
| GGGPAPGGS | 12,153 | MLVFF_P26809_3mutA |
| EAAAKGGSGGG | 12,154 | PERV_Q4VFZ2_3mut |
| EAAAKGGGGSS | 12,155 | MLVMS_P03355_3mutA_WS |
| GSSGSSGSSGSSGSSGSS | 12,156 | MLVMS_P03355_3mut |
| GGGGGGGGSGGGGSGGGGS | 12,157 | MLVBM_Q7SVK7_3mutA_WS |
| PAPAPAPAPAP | 12,158 | MLVMS_P03355_PLV919 |
| GGGEAAAKGGS | 12,159 | MLVMS_P03355_PLV919 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| AEAAAKEAAAKEAAAKEAAAKALEAEAAAKEAAAKEAAAKEAAAKA | 12,160 | MLVMS_P03355_3mut |
| GSAGSAAGSGEF | 12,161 | MLVMS_P03355_3mutA_WS |
| GSSGSSGSSGSSGSS | 12,162 | MLVFF_P26809_3mutA |
| EAAAKGGSGSS | 12,163 | MLVFF_P26809_3mutA |
| PAPGGG | 12,164 | MLVFF_P26809_3mutA |
| GGGPAPGSS | 12,165 | XMRV6_A1Z651_3mutA |
| PAPEAAAKGGS | 12,166 | AVIRE_P03360_3mutA |
| PAPGGGEAAAK | 12,167 | MLVFF_P26809_3mut |
| GGGGSSEAAAK | 12,168 | MLVCB_P08361_3mutA |
| EAAAK | 12,169 | MLVMS_P03355_PLV919 |
| GGGGSGGGGSGGGGSGGGGSGGGGSGGGGS | 12,170 | BAEVM_P10272_3mutA |
| GGSGGGEAAAK | 12,171 | MLVMS_P03355_PLV919 |
| AEAAAKEAAAKEAAAKEAAAKALEAEAAAKEAAAKEAAAKEAAAKA | 12,172 | MLVFF_P26809_3mutA |
| GSSPAPGGS | 12,173 | XMRV6_A1Z651_3mutA |
| GGSGGGPAP | 12,174 | MLVMS_P03355_PLV919 |
| EAAAK | 12,175 | AVIRE_P03360_3mutA |
| GSS | | XMRV6_A1Z651_3mutA |
| GGSGGSGGS | 12,177 | MLVFF_P26809_3mutA |
| EAAAKEAAAKEAAAKEAAAK | 12,178 | AVIRE_P03360_3mut |
| PAPEAAAKGGG | 12,179 | PERV_Q4VFZ2_3mutA_WS |
| GGGGGSEAAAK | 12,180 | BAEVM_P10272_3mutA |
| GGSGSSGGG | 12,181 | MLVMS_P03355_3mutA_WS |
| GGGGGGG | 12,182 | MLVMS_P03355_3mutA_WS |
| GSSEAAAKPAP | 12,183 | PERV_Q4VFZ2_3mut |
| GGGGGSEAAAK | 12,184 | WMSV_P03359_3mut |
| GGGGSGGGGGGGSGGGGSGGGGS | 12,185 | MLVFF_P26809_3mut |
| GGGEAAAKGGS | 12,186 | AVIRE_P03360_3mutA |
| GGSPAPGGG | 12,187 | AVIRE_P03360_3mutA |
| GSAGSAAGSGEF | 12,188 | MLVAV_P03356_3mutA |
| EAAAK | 12,189 | MLVAV_P03356_3mutA |
| EAAAKPAPGSS | 12,190 | WMSV_P03359_3mutA |
| EAAAKEAAAKEAAAKEAAAKEAAAK | 12,191 | PERV_Q4VFZ2_3mutA_WS |
| GGSEAAAKPAP | 12,192 | MLVCB_P08361_3mutA |
| PAPAPAPAPAPAP | 12,193 | MLVBM_Q7SVK7_3mutA_WS |
| GGSPAPGGG | 12,194 | MLVMS_P03355_3mutA_WS |
| GGSEAAAKGGG | 12,195 | MLVMS_P03355_3mut |
| GGSGGSGGSGGS | 12,196 | MLVFF_P26809_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKEAAAKEAAAKEAAAKEAAAK | 12,197 | MLVFF_P26809_3mutA |
| GGG | | AVIRE_P03360_3mutA |
| AEAAAKEAAAKEAAAKEAAAKALEAEAAAKEAAAKEAAAKEAAAKA | 12,199 | PERV_Q4VFZ2_3mut |
| GGSGGSGGSGGS | 12,200 | MLVMS_P03355_3mutA_WS |
| GGGEAAAK | 12,201 | MLVCB_P08361_3mutA |
| GSSGSSGSSGSSGSSGSS | 12,202 | MLVMS_P03355_3mutA_WS |
| GSSGGGPAP | 12,203 | MLVMS_P03355_3mutA_WS |
| GSSEAAAKPAP | 12,204 | MLVFF_P26809_3mutA |
| EAAAKEAAAK | 12,205 | MLVMS_P03355_PLV919 |
| GGGGSGGGGSGGGGSGGGGSGGGGSGGGGS | 12,206 | MLVCB_P08361_3mut |
| GGGGGG | 12,207 | MLVMS_P03355_3mutA_WS |
| GGSGSSGGG | 12,208 | MLVFF_P26809_3mutA |
| GSSGGGEAAAK | 12,209 | PERV_Q4VFZ2_3mutA_WS |
| PAPAPAPAPAP | 12,210 | PERV_Q4VFZ2_3mut |
| EAAAKEAAAKEAAAKEAAAKEAAAK | 12,211 | SFV3L_P27401_2mut |
| EAAAKGGSGGG | 12,212 | BAEVM_P10272_3mutA |
| GGGGSSPAP | 12,213 | PERV_Q4VFZ2_3mutA_WS |
| GGGEAAAKPAP | 12,214 | MLVMS_P03355_PLV919 |
| GGSGGGPAP | 12,215 | BAEVM_P10272_3mutA |
| PAPGSSGGS | 12,216 | MLVMS_P03355_PLV919 |
| GGSGGGPAP | 12,217 | MLVMS_P03355_3mutA_WS |
| EAAAKGGSPAP | 12,218 | PERV_Q4VFZ2_3mutA_WS |
| EAAAKGGSGGG | 12,219 | MLVMS_P03355_3mutA_WS |
| PAPGSSGGG | 12,220 | MLVFF_P26809_3mutA |
| GSSEAAAKGGS | 12,221 | MLVFF_P26809_3mutA |
| PAPGSSEAAAK | 12,222 | MLVFF_P26809_3mutA |
| EAAAKGSSPAP | 12,223 | KORV_Q9TTC1-Pro_3mutA |
| EAAAKEAAAKEAAAKEAAAKEAAAK | 12,224 | MLVBM_Q7SVK7_3mutA_WS |
| PAPGSSEAAAK | 12,225 | MLVMS_P03355_PLV919 |
| EAAAKGSSGGG | 12,226 | MLVMS_P03355_3mutA_WS |
| EAAAKGGGGS | 12,227 | AVIRE_P03360_3mutA |
| EAAAKEAAAKEAAAK | 12,228 | MLVMS_P03355_PLV919 |
| PAPAPAPAPAP | 12,229 | MLVFF_P26809_3mutA |
| GGGGSGGGGSGGGGS | 12,230 | MLVCB_P08361_3mutA |
| PAPGGSEAAAK | 12,231 | MLVCB_P08361_3mutA |
| PAPGSSEAAAK | 12,232 | MLVBM_Q7SVK7_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| PAPEAAAKGSS | 12,233 | AVIRE_P03360_3mutA |
| GGSPAPGSS | 12,234 | WMSV_P03359_3mutA |
| PAPGGSGGG | 12,235 | MLVMS_P03355_PLV919 |
| EAAAKGGSGSS | 12,236 | MLVMS_P03355_3mutA_WS |
| GGSGGG | 12,237 | MLVFF_P26809_3mutA |
| GGSEAAAKGSS | 12,238 | KORV_Q9TTC1_3mutA |
| AEAAAKEAAAKEAAAKEAAAKALEAEAAAKEAAAKEAAAKEAAAKA | 12,239 | MLVCB_P08361_3mutA |
| PAPAPAPAPAPAP | 12,240 | PERV_Q4VFZ2_3mutA_WS |
| PAPEAAAK | 12,241 | MLVMS_P03355_3mutA_WS |
| GGSEAAAKGGG | 12,242 | MLVMS_P03355_PLV919 |
| GSSPAP | 12,243 | MLVMS_P03355_3mutA_WS |
| GGGGSS | 12,244 | MLVMS_P03355_PLV919 |
| GGGEAAAKPAP | 12,245 | AVIRE_P03360_3mutA |
| EAAAKPAPGGS | 12,246 | MLVAV_P03356_3mutA |
| EAAAKGGGPAP | 12,247 | MLVAV_P03356_3mutA |
| PAPGGSEAAAK | 12,248 | BAEVM_P10272_3mutA |
| PAPGGSGSS | 12,249 | MLVMS_P03355_3mutA_WS |
| PAPGGSGSS | 12,250 | AVIRE_P03360_3mutA |
| GGSGGGPAP | 12,251 | MLVMS_P03355_3mutA_WS |
| EAAAKEAAAKEAAAKEAAAK | 12,252 | BAEVM_P10272_3mutA |
| GGGGSGGGGSGGGGSGGGGSGGGGS | 12,253 | MLVMS_P03355_PLV919 |
| GGGGSSPAP | 12,254 | MLVCB_P08361_3mutA |
| GSSGGGPAP | 12,255 | MLVFF_P26809_3mutA |
| GGGGSSGGS | 12,256 | MLVMS_P03355_PLV919 |
| GGSGGG | 12,257 | MLVCB_P08361_3mutA |
| GSSGGGGGS | 12,258 | MLVMS_P03355_PLV919 |
| SGGSSGGSSGSETPGTSESATPESSGGSSGGSS | 12,259 | XMRV6_A1Z651_3mutA |
| GGGGGSGSS | 12,260 | KORV_Q9TTC1_3mut |
| GGGEAAAKGGS | 12,261 | BAEVM_P10272_3mutA |
| GGSGGG | 12,262 | BAEVM_P10272_3mutA |
| PAPAPAP | 12,263 | KORV_Q9TTC1-Pro_3mut |
| AEAAAKEAAAKEAAAKEAAAKALEAEAAAKEAAAKEAAAKEAAAKA | 12,264 | SFV3L_P27401_2mutA |
| AEAAAKEAAAKEAAAKEAAAKALEAEAAAKEAAAKEAAAKEAAAKA | 12,265 | MLVBM_Q7SVK7_3mutA_WS |
| GSSGSSGSSGSSGSS | 12,266 | MLVMS_P03355_3mutA_WS |
| GSSGGGEAAAK | 12,267 | MLVMS_P03355_3mutA_WS |
| GSSGGSEAAAK | 12,268 | MLVFF_P26809_3mutA |
| PAP | | MLVMS_P03355_PLV919 |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKGGGGSEAAAK | 12,270 | MLVBM_Q7SVK7_3mutA_WS |
| PAPAP | 12,271 | AVIRE_P03360_3mutA |
| PAP |  | MLVFF_P26809_3mutA |
| GSSGGG | 12,273 | MLVMS_P03355_3mut |
| GSSPAPGGS | 12,274 | MLVFF_P26809_3mutA |
| PAPAPAPAP | 12,275 | XMRV6_A1Z651_3mutA |
| EAAAKGSSGGS | 12,276 | PERV_Q4VFZ2_3mut |
| PAPEAAAKGGG | 12,277 | KORV_Q9TTC1-Pro_3mutA |
| PAPGGS | 12,278 | MLVCB_P08361_3mutA |
| EAAAKGGG | 12,279 | MLVCB_P08361_3mutA |
| GSSEAAAKPAP | 12,280 | MLVMS_P03355_PLV919 |
| PAPGGS | 12,281 | MLVFF_P26809_3mutA |
| EAAAKGGS | 12,282 | MLVCB_P08361_3mutA |
| EAAAKEAAAKEAAAKEAAAKEAAAK | 12,283 | FLV_P10273_3mutA |
| PAPGGSEAAAK | 12,284 | MLVAV_P03356_3mutA |
| GSS |  | MLVCB_P08361_3mutA |
| GSSGSSGSSGSS | 12,286 | AVIRE_P03360_3mutA |
| GSSGSSGSS | 12,287 | MLVFF_P26809_3mutA |
| GSSGGG | 12,288 | MLVMS_P03355_PLV919 |
| EAAAK | 12,289 | MLVFF_P26809_3mutA |
| GGSPAPEAAAK | 12,290 | MLVCB_P08361_3mutA |
| GGSGSS | 12,291 | MLVCB_P08361_3mutA |
| GSSPAPGGG | 12,292 | MLVMS_P03355_PLV919 |
| EAAAKEAAAKEAAAKEAAAKEAAAK | 12,293 | MLVAV_P03356_3mutA |
| EAAAKGSSPAP | 12,294 | FLV_P10273_3mutA |
| GGGGSS | 12,295 | XMRV6_A1Z651_3mutA |
| GGSPAPGSS | 12,296 | MLVMS_P03355_PLV919 |
| EAAAKEAAAKEAAAKEAAAKEAAAK | 12,297 | MLVMS_P03355_3mutA_WS |
| PAPEAAAKGGG | 12,298 | FLV_P10273_3mutA |
| EAAAKPAPGGS | 12,299 | XMRV6_A1Z651_3mut |
| PAPAP | 12,300 | BAEVM_P10272_3mutA |
| EAAAKEAAAKEAAAKEAAAK | 12,301 | MLVMS_P03355_PLV919 |
| GSSPAPGGG | 12,302 | MLVMS_P03355_PLV919 |
| EAAAKGGGPAP | 12,303 | KORV_Q9TTC1_3mutA |
| PAPEAAAK | 12,304 | MLVMS_P03355_PLV919 |
| PAPGGGEAAAK | 12,305 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKGSSGGS | 12,306 | MLVMS_P03355_3mutA_WS |
| EAAAKEAAAKEAAAK | 12,307 | MLVMS_P03355_PLV919 |
| GSSEAAAK | 12,308 | MLVMS_P03355_3mutA_WS |
| GSSGSSGSSGSS | 12,309 | MLVMS_P03355_3mutA_WS |
| GGGGSGGGGSGGGGSGGGGS | 12,310 | MLVMS_P03355_3mutA_WS |
| EAAAKGGGGSEAAAK | 12,311 | MLVMS_P03355_3mut |
| GGS | | MLVCB_P08361_3mutA |
| GGGGSGGGGSGGGGSGGGGSGGGGSGGGGS | 12,313 | XMRV6_A1Z651_3mutA |
| GGSGSSPAP | 12,314 | MLVCB_P08361_3mutA |
| GGGGSGGGGSGGGGS | 12,315 | XMRV6_A1Z651_3mutA |
| PAPAPAPAPAP | 12,316 | BAEVM_P10272_3mutA |
| PAPAPAPAPAP | 12,317 | MLVMS_P03355_3mutA_WS |
| EAAAKEAAAKEAAAKEAAAK | 12,318 | MLVBM_Q7SVK7_3mut |
| GGGGSGGGGSGGGGSGGGGSGGGGS | 12,319 | BAEVM_P10272_3mutA |
| GGSGGSGGS | 12,320 | MLVMS_P03355_3mutA_WS |
| EAAAKPAPGSS | 12,321 | MLVMS_P03355_PLV919 |
| GSS | | MLVMS_P03355_3mutA_WS |
| PAPEAAAKGGS | 12,323 | MLVMS_P03355_3mutA_WS |
| GGGPAPGGS | 12,324 | MLVMS_P03355_3mutA_WS |
| EAAAKGGGGSS | 12,325 | MLVAV_P03356_3mutA |
| GSSGSSGSSGSSGSS | 12,326 | MLVFF_P26809_3mut |
| SGSETPGTSESATPES | 12,327 | PERV_Q4VFZ2_3mut |
| GGSEAAAKGGG | 12,328 | MLVMS_P03355_3mut |
| GSSGSSGSSGSSGSSGSS | 12,329 | AVIRE_P03360_3mutA |
| PAPAPAPAPAPAP | 12,330 | AVIRE_P03360_3mut |
| GGSGGS | 12,331 | XMRV6_A1Z651_3mutA |
| PAPGSSEAAAK | 12,332 | MLVCB_P08361_3mut |
| GGSPAPEAAAK | 12,333 | PERV_Q4VFZ2_3mut |
| EAAAKGGGGS | 12,334 | MLVCB_P08361_3mutA |
| GGSGGSGGSGGS | 12,335 | MLVMS_P03355_PLV919 |
| GGGGSSEAAAK | 12,336 | MLVMS_P03355_PLV919 |
| GSSEAAAKGGG | 12,337 | MLVFF_P26809_3mutA |
| PAPGGS | 12,338 | MLVMS_P03355_3mutA_WS |
| EAAAKGGSGGG | 12,339 | MLVCB_P08361_3mutA |
| EAAAKGGG | 12,340 | PERV_Q4VFZ2_3mut |
| PAPGGS | 12,341 | XMRV6_A1Z651_3mutA |
| GSSPAPGGG | 12,342 | XMRV6_A1Z651_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPEAAAKGGG | 12,343 | MLVMS_P03355_3mutA_WS |
| GSSEAAAKGGG | 12,344 | PERV_Q4VFZ2_3mutA_WS |
| PAPGGSEAAAK | 12,345 | XMRV6_A1Z651_3mutA |
| GGGGGS | 12,346 | MLVMS_P03355_3mutA_WS |
| GGSPAPEAAAK | 12,347 | MLVMS_P03355_3mutA_WS |
| GGGPAP | 12,348 | MLVFF_P26809_3mutA |
| PAPGSSGGG | 12,349 | XMRV6_A1Z651_3mutA |
| PAPGSSGGG | 12,350 | MLVBM_Q7SVK7_3mutA_WS |
| GGGEAAAKGSS | 12,351 | MLVMS_P03355_3mutA_WS |
| GSSEAAAKGGS | 12,352 | MLVCB_P08361_3mutA |
| PAPGGSGSS | 12,353 | MLVCB_P08361_3mutA |
| EAAAKGGGSEAAAK | 12,354 | BAEVM_P10272_3mutA |
| PAPAPAP | 12,355 | PERV_Q4VFZ2_3mutA_WS |
| GGGGGG | 12,356 | MLVAV_P03356_3mutA |
| GSSPAPEAAAK | 12,357 | MLVCB_P08361_3mutA |
| GGSGGSGGS | 12,358 | MLVMS_P03355_3mutA_WS |
| GSSGSSGSSGSSGSS | 12,359 | XMRV6_A1Z651_3mut |
| GGGPAPGGS | 12,360 | XMRV6_A1Z651_3mutA |
| GGGPAPEAAAK | 12,361 | BAEVM_P10272_3mutA |
| GGSGGG | 12,362 | AVIRE_P03360_3mutA |
| SGSETPGTSESATPES | 12,363 | PERV_Q4VFZ2_3mutA_WS |
| EAAAKGSSPAP | 12,364 | MLVMS_P03355_PLV919 |
| GSSEAAAK | 12,365 | XMRV6_A1Z651_3mut |
| GSSGGSGGG | 12,366 | MLVFF_P26809_3mutA |
| EAAAKEAAAKEAAAKEAAAKEAAAK | 12,367 | WMSV_P03359_3mutA |
| GGGGSEAAAKGGGGS | 12,368 | MLVMS_P03355_PLV919 |
| PAPGGGGSS | 12,369 | MLVMS_P03355_3mutA_WS |
| SGSETPGTSESATPES | 12,370 | MLVMS_P03355_3mutA_WS |
| GGSPAPEAAAK | 12,371 | KORV_Q9TTC1-Pro_3mutA |
| GSSEAAAKGGG | 12,372 | MLVMS_P03355_3mutA_WS |
| GSSEAAAK | 12,373 | WMSV_P03359_3mutA |
| GGGGSEAAAKGGGGS | 12,374 | AVIRE_P03360_3mutA |
| GSS | | WMSV_P03359_3mutA |
| PAPGGSEAAAK | 12,376 | MLVFF_P26809_3mutA |
| GGGGS | 12,377 | MLVMS_P03355_3mutA_WS |
| GGGPAP | 12,378 | MLVMS_P03355_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKEAAAKEAAAKEAAAKEAAAKEAAAK | 12,379 | MLVMS_P03355_3mutA_WS |
| EAAAKPAPGSS | 12,380 | PERV_Q4VFZ2_3mut |
| EAAAKPAPGSS | 12,381 | MLVCB_P08361_3mutA |
| GGGGGG | 12,382 | WMSV_P03359_3mutA |
| EAAAKPAPGGS | 12,383 | MLVMS_P03355_PLV919 |
| PAPGGGEAAAK | 12,384 | PERV_Q4VFZ2_3mut |
| EAAAKEAAAKEAAAKEAAAKEAAAK | 12,385 | AVIRE_P03360_3mutA |
| GSSEAAAKPAP | 12,386 | XMRV6_A1Z651_3mutA |
| PAPGGSEAAAK | 12,387 | MLVBM_Q7SVK7_3mutA_WS |
| PAPGSS | 12,388 | MLVCB_P08361_3mutA |
| EAAAKGGG | 12,389 | MLVMS_P03355_3mutA_WS |
| EAAAKPAP | 12,390 | MLVCB_P08361_3mutA |
| PAPEAAAKGGS | 12,391 | MLVBM_Q7SVK7_3mutA_WS |
| GGSPAPGGG | 12,392 | MLVCB_P08361_3mutA |
| PAPGGSGSS | 12,393 | WMSV_P03359_3mutA |
| EAAAKEAAAKEAAAKEAAAKEAAAK | 12,394 | MLVMS_P03355_PLV919 |
| GGSGGGPAP | 12,395 | MLVMS_P03355_PLV919 |
| AEAAAKEAAAKEAAAKEAAAKALEAEAAAKEAAAKEAAAKEAAAKA | 12,396 | MLVMS_P03355 |
| PAPEAAAKGSS | 12,397 | MLVCB_P08361_3mutA |
| EAAAKGSS | 12,398 | MLVMS_P03355_3mutA_WS |
| GGSGGS | 12,399 | MLVMS_P03355_3mutA_WS |
| EAAAKEAAAKEAAAKEAAAKEAAAK | 12,400 | BAEVM_P10272_3mutA |
| GGGGSEAAAKGGGGS | 12,401 | FLV_P10273_3mutA |
| GGSEAAAKGGG | 12,402 | MLVCB_P08361_3mutA |
| GSSGSSGSSGSSGSS | 12,403 | BAEVM_P10272_3mutA |
| GGGGSGGGGSGGGGSGGGGGGGSGGGGS | 12,404 | MLVFF_P26809_3mutA |
| EAAAKGGG | 12,405 | PERV_Q4VFZ2_3mut |
| GGGGSEAAAK | 12,406 | MLVCB_P08361_3mutA |
| EAAAKPAPGGS | 12,407 | MLVMS_P03355_3mutA_WS |
| GGGGGSGSS | 12,408 | XMRV6_A1Z651_3mutA |
| PAPGSSEAAAK | 12,409 | MLVMS_P03355_3mutA_WS |
| GSSEAAAKPAP | 12,410 | MLVCB_P08361_3mutA |
| EAAAKGSSPAP | 12,411 | MLVAV_P03356_3mutA |
| GGGPAPGGS | 12,412 | WMSV_P03359_3mutA |
| GGSPAP | 12,413 | MLVMS_P03355_3mutA_WS |
| GGSEAAAKGGG | 12,414 | MLVMS_P03355_3mutA_WS |
| GGGGGGGG | 12,415 | MLVFF_P26809_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGSGGGGSGGGGSGGGGSGGGGSGGGGS | 12,416 | MLVMS_P03355_3mutA_WS |
| GGGGSGGGGSGGGGSGGGGSGGGGSGGGGS | 12,417 | MLVBM_Q7SVK7_3mutA_WS |
| GSSPAPGGG | 12,418 | MLVAV_P03356_3mutA |
| GGGGGG | 12,419 | AVIRE_P03360_3mutA |
| GSSGGS | 12,420 | MLVMS_P03355_3mutA_WS |
| GGSPAPGSS | 12,421 | MLVFF_P26809_3mutA |
| PAPEAAAKGGG | 12,422 | PERV_Q4VFZ2_3mut |
| EAAAKGGGPAP | 12,423 | MLVFF_P26809_3mutA |
| GGGEAAAKGGS | 12,424 | MLVMS_P03355_PLV919 |
| GGSGSSPAP | 12,425 | MLVFF_P26809_3mutA |
| SGSETPGTSESATPES | 12,426 | WMSV_P03359_3mutA |
| PAPGGSEAAAK | 12,427 | MLVBM_Q7SVK7_3mutA_WS |
| GGSGGG | 12,428 | MLVMS_P03355_PLV919 |
| GGGGSSPAP | 12,429 | PERV_Q4VFZ2_3mut |
| GGGEAAAKGSS | 12,430 | MLVAV_P03356_3mutA |
| PAPAPAPAPAPAP | 12,431 | MLVMS_P03355_3mutA_WS |
| EAAAKGGGGSEAAAK | 12,432 | PERV_Q4VFZ2 |
| EAAAKEAAAKEAAAKEAAAKEAAAK | 12,433 | MLVMS_P03355_PLV919 |
| GGGGGSEAAAK | 12,434 | PERV_Q4VFZ2_3mut |
| PAPGSSEAAAK | 12,435 | MLVCB_P08361_3mutA |
| GSAGSAAGSGEF | 12,436 | PERV_Q4VFZ2_3mutA_WS |
| EAAAKGGGGSEAAAK | 12,437 | MLVFF_P26809_3mutA |
| GGSPAPGGG | 12,438 | PERV_Q4VFZ2_3mutA_WS |
| GSSEAAAKGGG | 12,439 | AVIRE_P03360_3mutA |
| GGGEAAAKPAP | 12,440 | MLVMS_P03355_3mutA_WS |
| GGGPAP | 12,441 | AVIRE_P03360_3mutA |
| GGSEAAAK | 12,442 | MLVCB_P08361_3mutA |
| SGGSSGGSSGSETPGTSESATPESSGGSSGGSS | 12,443 | PERV_Q4VFZ2_3mut |
| EAAAKPAPGGS | 12,444 | MLVBM_Q7SVK7_3mutA_WS |
| AEAAAKEAAAKEAAAKEAAAKALEAEAAAKEAAAKEAAAKEAAAKA | 12,445 | XMRV6_A1Z651_3mut |
| GGGGGGGG | 12,446 | MLVCB_P08361_3mutA |
| PAPGSS | 12,447 | PERV_Q4VFZ2_3mut |
| EAAAK | 12,448 | PERV_Q4VFZ2_3mut |
| GSAGSAAGSGEF | 12,449 | MLVMS_P03355_3mutA_WS |
| PAPGGGEAAAK | 12,450 | PERV_Q4VFZ2_3mut |
| EAAAKGSSGGS | 12,451 | MLVFF_P26809_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGSEAAAKGGGGS | 12,452 | BAEVM_P10272_3mutA |
| GGGGSGGGGSGGGGS | 12,453 | MLVMS_P03355_PLV919 |
| EAAAKGGGGSEAAAK | 12,454 | BAEVM_P10272_3mut |
| PAPGGGEAAAK | 12,455 | MLVMS_P03355_3mutA_WS |
| GGSEAAAKPAP | 12,456 | MLVMS_P03355_3mutA_WS |
| PAPAP | 12,457 | MLVCB_P08361_3mutA |
| PAPAP | 12,458 | MLVFF_P26809_3mutA |
| GGSPAP | 12,459 | AVIRE_P03360_3mutA |
| EAAAKGSSGGS | 12,460 | MLVCB_P08361_3mutA |
| PAPGSSGGS | 12,461 | AVIRE_P03360_3mutA |
| EAAAKGGGGSEAAAK | 12,462 | XMRV6_A1Z651_3mutA |
| PAPAPAP | 12,463 | BAEVM_P10272_3mutA |
| GGSGGSGGSGGSGGSGGS | 12,464 | MLVMS_P03355_PLV919 |
| GGGGGSGSS | 12,465 | MLVMS_P03355_PLV919 |
| PAPGSSEAAAK | 12,466 | XMRV6_A1Z651_3mut |
| GGSEAAAKPAP | 12,467 | XMRV6_A1Z651_3mutA |
| EAAAKEAAAKEAAAKEAAAK | 12,468 | XMRV6_A1Z651_3mut |
| AEAAAKEAAAKEAAAKEAAAKALEAEAAAKEAAAKEAAAKEAAAKA | 12,469 | WMSV_P03359_3mut |
| GGSGGGEAAAK | 12,470 | XMRV6_A1Z651_3mutA |
| GGGEAAAK | 12,471 | XMRV6_A1Z651_3mutA |
| GGGGSGGGGSGGGGS | 12,472 | MLVMS_P03355_3mutA_WS |
| GGSGGSGGSGGSGGS | 12,473 | MLVFF_P26809_3mutA |
| GSSGGGGGS | 12,474 | MLVMS_P03355_3mut |
| PAPGGSEAAAK | 12,475 | MLVMS_P03355_3mutA_WS |
| GSSGGSPAP | 12,476 | MLVMS_P03355_3mutA_WS |
| SGSETPGTSESATPES | 12,477 | XMRV6_A1Z651_3mutA |
| GGGGSGGGGS | 12,478 | MLVMS_P03355_PLV919 |
| PAPAPAPAPAP | 12,479 | MLVMS_P03355_3mut |
| GSSGSS | 12,480 | XMRV6_A1Z651_3mutA |
| GSSEAAAKPAP | 12,481 | PERV_Q4VFZ2_3mut |
| GGSGSSGGG | 12,482 | MLVMS_P03355_3mutA_WS |
| EAAAKEAAAK | 12,483 | MLVCB_P08361_3mutA |
| GSSGSSGSSGSS | 12,484 | MLVMS_P03355_3mutA_WS |
| GSSPAPGGG | 12,485 | PERV_Q4VFZ2_3mutA_WS |
| EAAAKEAAAKEAAAK | 12,486 | MLVMS_P03355_3mutA_WS |
| AEAAAKEAAAKEAAAKEAAAKALEAEAAAKEAAAKEAAAKEAAAKA | 12,487 | SFV1_P23074_2mutA |
| GGGGSGGGGSGGGGSGGGGSGGGGSGGGGS | 12,488 | MLVMS_P03355_PLV919 |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GSAGSAAGSGEF | 12,489 | MLVMS_P03355_PLV919 |
| PAPGSSEAAAK | 12,490 | MLVMS_P03355_3mutA_WS |
| GGSEAAAK | 12,491 | MLVMS_P03355_3mutA_WS |
| GSSGSSGSSGSSGSS | 12,492 | PERV_Q4VFZ2_3mutA_WS |
| GGSEAAAKPAP | 12,493 | PERV_Q4VFZ2_3mutA_WS |
| GGSGGSGGS | 12,494 | MLVCB_P08361_3mutA |
| EAAAKGGSGSS | 12,495 | MLVCB_P08361_3mutA |
| GGGGSGGGGSGGGGSGGGGSGGGGS | 12,496 | FLV_P10273_3mutA |
| EAAAKEAAAKEAAAKEAAAK | 12,497 | MLVBM_Q7SVK7_3mutA_WS |
| GGSGSSPAP | 12,498 | BAEVM_P10272_3mutA |
| EAAAKEAAAKEAAAKEAAAKEAAAK | 12,499 | XMRV6_A1Z651_3mutA |
| GGGGSGGGGSGGGGSGGGGSGGGGS | 12,500 | MLVBM_Q7SVK7_3mutA_WS |
| GGSGSS | 12,501 | WMSV_P03359_3mutA |
| PAPEAAAK | 12,502 | MLVCB_P08361_3mutA |
| EAAAKPAP | 12,503 | BAEVM_P10272_3mutA |
| GSSPAP | 12,504 | PERV_Q4VFZ2_3mutA_WS |
| GGGPAP | 12,505 | PERV_Q4VFZ2_3mutA_WS |
| EAAAKGGSGSS | 12,506 | MLVMS_P03355_3mutA_WS |
| EAAAKGGGGSEAAAK | 12,507 | AVIRE_P03360_3mutA |
| GGSGGG | 12,508 | KORV_Q9TTC1-Pro_3mutA |
| GSSPAP | 12,509 | MLVFF_P26809_3mutA |
| GGSGSSEAAAK | 12,510 | BAEVM_P10272_3mutA |
| PAPGSSGGS | 12,511 | BAEVM_P10272_3mutA |
| GGGGGG | 12,512 | MLVFF_P26809_3mutA |
| PAPGGSEAAAK | 12,513 | MLVMS_P03355_PLV919 |
| PAPGGS | 12,514 | MLVMS_P03355_PLV919 |
| GGSGGSGGSGGS | 12,515 | BAEVM_P10272_3mutA |
| GSSPAP | 12,516 | MLVCB_P08361_3mutA |
| PAPAPAPAP | 12,517 | MLVMS_P03355_3mutA_WS |
| GGGGGG | 12,518 | MLVCB_P08361_3mutA |
| GSSGSSGSSGSSGSSGSS | 12,519 | KORV_Q9TTC1-Pro_3mutA |
| GSSEAAAKGGS | 12,520 | BAEVM_P10272_3mutA |
| GGSEAAAK | 12,521 | FLV_P10273_3mutA |
| GGSGGSGGSGGSGGS | 12,522 | KORV_Q9TTC1-Pro_3mutA |
| GSSPAPEAAAK | 12,523 | PERV_Q4VFZ2_3mut |
| GSSGSSGSSGSSGSS | 12,524 | XMRV6_A1Z651_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKPAPGGS | 12,525 | MLVMS_P03355_3mut |
| SGGSSGGSSGSETPGTSESATPESSGGSSGGSS | 12,526 | FLV_P10273_3mut |
| GGSPAPEAAAK | 12,527 | XMRV6_A1Z651_3mut |
| EAAAKGGSGGG | 12,528 | MLVFF_P26809_3mutA |
| EAAAKEAAAKEAAAKEAAAK | 12,529 | MLVFF_P26809_3mutA |
| GSSPAP | 12,530 | WMSV_P03359_3mutA |
| PAPAPAPAP | 12,531 | MLVAV_P03356_3mutA |
| PAPGGSEAAAK | 12,532 | KORV_Q9TTC1_3mut |
| GGSGSSEAAAK | 12,533 | MLVBM_Q7SVK7_3mutA_WS |
| GSSGGG | 12,534 | MLVCB_P08361_3mutA |
| GGGEAAAKGSS | 12,535 | PERV_Q4VFZ2_3mut |
| PAPGGSGGG | 12,536 | MLVFF_P26809_3mutA |
| AEAAAKEAAAKEAAAKEAAAKALEAEAAAKEAAAKEAAAKEAAAKA | 12,537 | FFV_093209 |
| PAPGGGGSS | 12,538 | MLVMS_P03355_3mutA_WS |
| EAAAKGGS | 12,539 | MLVAV_P03356_3mutA |
| EAAAKEAAAKEAAAKEAAAKEAAAKEAAAK | 12,540 | MLVBM_Q7SVK7_3mutA_WS |
| GGSGGSGGS | 12,541 | WMSV_P03359_3mutA |
| PAPAP | 12,542 | MLVMS_P03355_3mutA_WS |
| GSSGGGEAAAK | 12,543 | MLVAV_P03356_3mutA |
| GGGGSSEAAAK | 12,544 | MLVFF_P26809_3mutA |
| EAAAKGSSGGS | 12,545 | MLVMS_P03355_PLV919 |
| EAAAKGGGGSEAAAK | 12,546 | MLVMS_P03355_3mutA_WS |
| GGGGGGGG | 12,547 | MLVMS_P03355_PLV919 |
| GSSGSSGSS | 12,548 | MLVMS_P03355_PLV919 |
| GGGEAAAKPAP | 12,549 | PERV_Q4VFZ2_3mutA_WS |
| GGGGGSGSS | 12,550 | MLVMS_P03355_3mutA_WS |
| GGGGGGG | 12,551 | MLVMS_P03355_PLV919 |
| GGS | | MLVMS_P03355_PLV919 |
| GSSGGG | 12,553 | MLVMS_P03355_3mutA_WS |
| EAAAKGGSGSS | 12,554 | PERV_Q4VFZ2_3mutA_WS |
| PAPGSSEAAAK | 12,555 | MLVMS_P03355_PLV919 |
| GSSEAAAKPAP | 12,556 | MLVMS_P03355_PLV919 |
| GGSPAPGSS | 12,557 | BAEVM_P10272_3mutA |
| GSAGSAAGSGEF | 12,558 | MLVCB_P08361_3mut |
| GGSPAPGGG | 12,559 | PERV_Q4VFZ2_3mut |
| GGGGSGGGGSGGGGSGGGGS | 12,560 | MLVMS_P03355_3mut |
| GSSGSSGSS | 12,561 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKEAAAKEAAAKEAAAKEAAAK | 12,562 | PERV_Q4VFZ2_3mut |
| GGGGSEAAAKGGGGS | 12,563 | MLVCB_P08361_3mutA |
| GGSEAAAKGSS | 12,564 | MLVAV_P03356_3mutA |
| EAAAKGGGGSEAAAK | 12,565 | MLVCB_P08361_3mut |
| EAAAKEAAAKEAAAKEAAAKEAAAK | 12,566 | XMRV6_A1Z651_3mutA |
| PAPGGGEAAAK | 12,567 | MLVMS_P03355_3mutA_WS |
| GSSGGGEAAAK | 12,568 | PERV_Q4VFZ2_3mutA_WS |
| GSSGSS | 12,569 | MLVCB_P08361_3mut |
| PAPAPAPAPAPAP | 12,570 | PERV_Q4VFZ2_3mut |
| GGSPAPGGG | 12,571 | MLVFF_P26809_3mutA |
| GGSGGSGGSGGSGGS | 12,572 | MLVCB_P08361_3mut |
| EAAAKEAAAK | 12,573 | MLVFF_P26809_3mutA |
| AEAAAKEAAAKEAAAKEAAAKALEAEAAAKEAAAKEAAAKEAAAKA | 12,574 | GALV_P21414_3mut |
| PAPAPAPAPAPAP | 12,575 | WMSV_P03359_3mutA |
| GGGEAAAKGGS | 12,576 | KORV_Q9TTC1_3mutA |
| EAAAKGGGPAP | 12,577 | KORV_Q9TTC1_3mut |
| PAPEAAAKGSS | 12,578 | MLVBM_Q7SVK7_3mutA_WS |
| PAPEAAAKGSS | 12,579 | FLV_P10273_3mutA |
| PAPGGSEAAAK | 12,580 | MLVMS_P03355_3mut |
| GSSPAPGGG | 12,581 | BAEVM_P10272_3mutA |
| GGGEAAAKPAP | 12,582 | KORV_Q9TTC1-Pro_3mutA |
| GGGGSGGGGS | 12,583 | MLVMS_P03355_PLV919 |
| GGGEAAAKGSS | 12,584 | MLVFF_P26809_3mutA |
| PAPGGGGSS | 12,585 | MLVBM_Q7SVK7_3mutA_WS |
| GSSEAAAK | 12,586 | BAEVM_P10272_3mutA |
| GGGGGGGG | 12,587 | MLVMS_P03355_PLV919 |
| PAPGSSGGS | 12,588 | MLVAV_P03356_3mutA |
| GGGGSGGGGSGGGGSGGGGS | 12,589 | BAEVM_P10272_3mutA |
| PAP | | MLVMS_P03355_3mut |
| EAAAKGSSPAP | 12,591 | XMRV6_A1Z651_3mutA |
| PAPEAAAKGGS | 12,592 | MLVFF_P26809_3mutA |
| GSSGGGEAAAK | 12,593 | BAEVM_P10272_3mutA |
| PAPAPAP | 12,594 | MLVMS_P03355_3mutA_WS |
| GGSEAAAKGGG | 12,595 | MLVMS_P03355_PLV919 |
| GSSEAAAK | 12,596 | PERV_Q4VFZ2_3mut |
| GGGG | 12,597 | MLVMS_P03355_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGGS | 12,598 | MLVMS_P03355_3mut |
| GGGGSSEAAAK | 12,599 | PERV_Q4VFZ2_3mut |
| EAAAKEAAAKEAAAKEAAAKEAAAK | 12,600 | SFV3L_P27401-Pro_2mutA |
| GGSEAAAKGSS | 12,601 | MLVMS_P03355_3mutA_WS |
| PAPGSSGGS | 12,602 | XMRV6_A1Z651_3mutA |
| GGSPAP | 12,603 | MLVMS_P03355_3mutA_WS |
| GGGGSSEAAAK | 12,604 | BAEVM_P10272_3mut |
| GGSGGSGGSGGS | 12,605 | AVIRE_P03360_3mutA |
| PAPGSSGGS | 12,606 | MLVFF_P26809_3mutA |
| GSSPAPGGG | 12,607 | MLVMS_P03355_3mutA_WS |
| GGGGGGG | 12,608 | MLVMS_P03355_3mutA_WS |
| EAAAKGGGGS | 12,609 | MLVMS_P03355_3mutA_WS |
| EAAAKGGSGG | 12,610 | MLVMS_P03355_PLV919 |
| GGGGSSEAAAK | 12,611 | XMRV6_A1Z651_3mutA |
| GGGGSEAAAKGGGGS | 12,612 | MLVBM_Q7SVK7_3mutA_WS |
| GSSGSS | 12,613 | MLVMS_P03355_PLV919 |
| GGSGGG | 12,614 | MLVMS_P03355_PLV919 |
| PAPEAAAKGGG | 12,615 | AVIRE_P03360_3mutA |
| AEAAAKEAAAKEAAAKEAAAKALEAEAAAKEAAAKEAAAKEAAAKA | 12,616 | FOAMV_P14350-Pro_2mutA |
| GGGGGSGSS | 12,617 | PERV_Q4VFZ2_3mut |
| GSSGSSGSSGSSGSS | 12,618 | KORV_Q9TTC1-Pro_3mut |
| GGGGSEAAAKGGGGS | 12,619 | MLVMS_P03355_3mutA_WS |
| GGGGGSPAP | 12,620 | FLV_P10273_3mut |
| GGGEAAAK | 12,621 | MLVMS_P03355_3mutA_WS |
| GGSGGSGGSGGS | 12,622 | FLV_P10273_3mutA |
| GGG | | MLVMS_P03355_PLV919 |
| GGSPAPEAAAK | 12,624 | BAEVM_P10272_3mutA |
| EAAAKEAAAK | 12,625 | FLV_P10273_3mutA |
| GGGEAAAKPAP | 12,626 | BAEVM_P10272_3mutA |
| GGGEAAAKGGS | 12,627 | PERV_Q4VFZ2_3mut |
| GGSGGSGGS | 12,628 | PERV_Q4VFZ2_3mut |
| EAAAKGGGPAP | 12,629 | XMRV6_A1Z651_3mutA |
| EAAAK | 12,630 | MLVBM_Q7SVK7_3mutA_WS |
| PAPEAAAKGGG | 12,631 | PERV_Q4VFZ2_3mut |
| EAAAKGSS | 12,632 | MLVCB_P08361_3mutA |
| GGSEAAAKGGG | 12,633 | MLVBM_Q7SVK7_3mutA_WS |
| GGGGSGGGGSGGGGSGGGGS | 12,634 | XMRV6_A1Z651_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSGGGGSGGGGSGGGGSGGGGS | 12,635 | BAEVM_P10272_3mut |
| GGGGSSPAP | 12,636 | PERV_Q4VFZ2_3mutA_WS |
| GGSGGSGGSGGSGGSGGS | 12,637 | PERV_Q4VFZ2_3mut |
| GGGEAAAKPAP | 12,638 | PERV_Q4VFZ2_3mut |
| EAAAKEAAAK | 12,639 | BAEVM_P10272_3mutA |
| GGSGSSEAAAK | 12,640 | XMRV6_A1Z651_3mutA |
| PAPEAAAKGSS | 12,641 | WMSV_P03359_3mutA |
| PAPAPAPAPAP | 12,642 | XMRV6_A1Z651_3mutA |
| GSSGGGEAAAK | 12,643 | MLVMS_P03355_PLV919 |
| GSSPAPGGG | 12,644 | MLVFF_P26809_3mutA |
| GGSPAPEAAAK | 12,645 | MLVFF_P26809_3mut |
| PAPGGSEAAAK | 12,646 | PERV_Q4VFZ2_3mut |
| GGGGSS | 12,647 | MLVFF_P26809_3mutA |
| GGSGSSGGG | 12,648 | BAEVM_P10272_3mutA |
| GSSGGGEAAAK | 12,649 | MLVMS_P03355_3mutA_WS |
| EAAAKGGS | 12,650 | MLVBM_Q7SVK7_3mutA_WS |
| GGGPAPGGS | 12,651 | MLVMS_P03355_PLV919 |
| EAAAKEAAAK | 12,652 | MLVMS_P03355_PLV919 |
| GSSGSSGSS | 12,653 | MLVMS_P03355_PLV919 |
| GGGEAAAKPAP | 12,654 | MLVAV_P03356_3mutA |
| SGSETPGTSESATPES | 12,655 | FLV_P10273_3mutA |
| PAPAPAPAPAP | 12,656 | KORV_Q9TTC1-Pro_3mut |
| AEAAAKEAAAKEAAAKEAAAKALEAEAAAKEAAAKEAAAKEAAAKA | 12,657 | BAEVM_P10272_3mutA |
| PAPGSSGGG | 12,658 | MLVMS_P03355_3mutA_WS |
| GSSGGGEAAAK | 12,659 | XMRV6_A1Z651_3mutA |
| GGGGSGGGGSGGGGSGGGGSGGGGS | 12,660 | XMRV6_A1Z651_3mutA |
| GGGGSSPAP | 12,661 | MLVFF_P26809_3mutA |
| GGSGGGPAP | 12,662 | PERV_Q4VFZ2_3mutA_WS |
| GSS | | PERV_Q4VFZ2_3mut |
| EAAAKGSSPAP | 12,664 | MLVMS_P03355_3mut |
| EAAAKGGG | 12,665 | XMRV6_A1Z651_3mutA |
| GSSGSSGSSGSS | 12,666 | WMSV_P03359_3mutA |
| PAPEAAAKGSS | 12,667 | MLVMS_P03355_PLV919 |
| GSSEAAAK | 12,668 | AVIRE_P03360_3mutA |
| EAAAKGGSGSS | 12,669 | AVIRE_P03360_3mutA |
| GSSEAAAK | 12,670 | MLVMS_P03355_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGSGSSEAAAK | 12,671 | MLVMS_P03355_PLV919 |
| GGSEAAAKGGG | 12,672 | MLVFF_P26809_3mutA |
| GGGGSGGGGSGGGGSGGGGS | 12,673 | MLVAV_P03356_3mutA |
| PAPAPAPAPAPAP | 12,674 | MLVFF_P26809_3mut |
| EAAAKPAPGSS | 12,675 | KORV_Q9TTC1-Pro_3mut |
| PAPGSSEAAAK | 12,676 | MLVAV_P03356_3mutA |
| GGGGSSPAP | 12,677 | WMSV_P03359_3mutA |
| EAAAKGGGGS | 12,678 | MLVMS_P03355_3mutA_WS |
| GGGEAAAKGGS | 12,679 | MLVMS_P03355_3mut |
| GGSGSSGGG | 12,680 | MLVMS_P03355_3mut |
| GGGPAPGGS | 12,681 | MLVAV_P03356_3mutA |
| PAPGGGGGS | 12,682 | MLVMS_P03355_PLV919 |
| GGGPAPGSS | 12,683 | PERV_Q4VFZ2_3mut |
| GGGGGGG | 12,684 | MLVFF_P26809_3mutA |
| GGSGGGGSS | 12,685 | MLVCB_P08361_3mutA |
| GGGGGG | 12,686 | FLV_P10273_3mutA |
| GGSEAAAKGSS | 12,687 | PERV_Q4VFZ2_3mut |
| GGSPAPGGG | 12,688 | BAEVM_P10272_3mutA |
| GGSPAPGSS | 12,689 | AVIRE_P03360_3mutA |
| GGSGGSGGSGGS | 12,690 | KORV_Q9TTC1_3mut |
| EAAAKEAAAKEAAAKEAAAKEAAAK | 12,691 | MLVBM_Q7SVK7_3mut |
| PAPGSSGGS | 12,692 | XMRV6_A1Z651_3mut |
| EAAAKGGGGSS | 12,693 | PERV_Q4VFZ2_3mutA_WS |
| GGSGGSGGSGGSGGS | 12,694 | PERV_Q4VFZ2_3mutA_WS |
| PAPGGSGGG | 12,695 | MLVMS_P03355_PLV919 |
| PAPGSSGGG | 12,696 | PERV_Q4VFZ2_3mutA_WS |
| GSSGSS | 12,697 | BAEVM_P10272_3mutA |
| EAAAKGSS | 12,698 | MLVFF_P26809_3mutA |
| GGGPAP | 12,699 | MLVMS_P03355_PLV919 |
| EAAAKGGGGGS | 12,700 | MLVFF_P26809_3mutA |
| EAAAKGGSPAP | 12,701 | MLVBM_Q7SVK7_3mutA_WS |
| EAAAKEAAAKEAAAKEAAAKEAAAKEAAAK | 12,702 | WMSV_P03359_3mutA |
| GSSPAPGGG | 12,703 | MLVBM_Q7SVK7_3mutA_WS |
| GGGEAAAKGSS | 12,704 | AVIRE_P03360_3mutA |
| GGGGSSEAAAK | 12,705 | AVIRE_P03360_3mutA |
| GGGGGGGG | 12,706 | PERV_Q4VFZ2_3mutA_WS |
| PAPGSSEAAAK | 12,707 | BAEVM_P10272_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGSS | 12,708 | MLVFF_P26809_3mut |
| GSSEAAAKGGG | 12,709 | MLVCB_P08361_3mutA |
| GGSEAAAK | 12,710 | MLVBM_Q7SVK7_3mutA_WS |
| GSSEAAAKGGG | 12,711 | PERV_Q4VFZ2_3mutA_WS |
| PAPGGSGGG | 12,712 | WMSV_P03359_3mutA |
| GSSGGSGGG | 12,713 | MLVCB_P08361_3mutA |
| EAAAKGSSGGG | 12,714 | FLV_P10273_3mutA |
| GSSEAAAK | 12,715 | MLVCB_P08361_3mutA |
| GSSGGGEAAAK | 12,716 | MLVMS_P03355_3mut |
| GGGGSGGGGS | 12,717 | MLVCB_P08361_3mutA |
| EAAAKGGGGSEAAAK | 12,718 | MLVBM_Q7SVK7_3mutA_WS |
| EAAAKGGG | 12,719 | PERV_Q4VFZ2_3mutA_WS |
| EAAAKGGSPAP | 12,720 | MLVMS_P03355_PLV919 |
| GGGPAPGGS | 12,721 | AVIRE_P03360_3mutA |
| GSSEAAAK | 12,722 | MLVBM_Q7SVK7_3mutA_WS |
| GSSGGGEAAAK | 12,723 | PERV_Q4VFZ2_3mut |
| SGSETPGTSESATPES | 12,724 | MLVMS_P03355_PLV919 |
| GGSGSSPAP | 12,725 | MLVMS_P03355_3mut |
| GGGGGG | 12,726 | MLVBM_Q7SVK7_3mutA_WS |
| GGSPAPGGG | 12,727 | XMRV6_A1Z651_3mutA |
| GGSGSS | 12,728 | PERV_Q4VFZ2_3mutA_WS |
| PAP | | MLVBM_Q7SVK7_3mutA_WS |
| EAAAKPAPGSS | 12,730 | MLVMS_P03355_PLV919 |
| EAAAKGGG | 12,731 | MLVMS_P03355_3mut |
| GSSEAAAKPAP | 12,732 | PERV_Q4VFZ2_3mutA_WS |
| GGGGSS | 12,733 | MLVMS_P03355_3mutA_WS |
| GGSGSSEAAAK | 12,734 | PERV_Q4VFZ2_3mut |
| GGGGSS | 12,735 | BAEVM_P10272_3mutA |
| PAPAP | 12,736 | MLVFF_P26809_3mut |
| PAPEAAAKGGG | 12,737 | BAEVM_P10272_3mutA |
| EAAAKGSS | 12,738 | MLVMS_P03355_PLV919 |
| PAPAPAPAPAPAP | 12,739 | PERV_Q4VFZ2_3mutA_WS |
| GGGGGSEAAAK | 12,740 | MLVMS_P03355_3mut |
| PAPGGS | 12,741 | PERV_Q4VFZ2_3mut |
| GGGGSS | 12,742 | MLVCB_P08361_3mutA |
| GGGGS | 12,743 | MLVAV_P03356_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSPAPEAAAK | 12,744 | MLVMS_P03355_PLV919 |
| GGGGSSGGS | 12,745 | MLVFF_P26809_3mutA |
| PAPEAAAKGSS | 12,746 | MLVMS_P03355_PLV919 |
| GGSGSSEAAAK | 12,747 | MLVMS_P03355_3mutA_WS |
| EAAAKGGG | 12,748 | MLVAV_P03356_3mutA |
| PAPGSSEAAAK | 12,749 | FLV_P10273_3mutA |
| EAAAKGSSGGG | 12,750 | MLVCB_P08361_3mutA |
| PAPEAAAK | 12,751 | KORV_Q9TTC1-Pro_3mutA |
| GGSPAPEAAAK | 12,752 | KORV_Q9TTC1-Pro_3mut |
| GGSGGSGGSGGSGGSGGS | 12,753 | MLVAV_P03356_3mutA |
| GSSEAAAKPAP | 12,754 | MLVBM_Q7SVK7_3mutA_WS |
| AEAAAKEAAAKEAAAKEAAAKALEAEAAAKEAAAKEAAAKEAAAKA | 12,755 | KORV_Q9TTC1-Pro_3mutA |
| GSSGGGEAAAK | 12,756 | XMRV6_A1Z651_3mut |
| PAPGGSGGG | 12,757 | AVIRE_P03360_3mutA |
| PAPGGSEAAAK | 12,758 | PERV_Q4VFZ2_3mutA_WS |
| GGGGS | 12,759 | MLVMS_P03355_3mutA_WS |
| GGGGSGGGGSGGGGS | 12,760 | MLVBM_Q7SVK7_3mutA_WS |
| PAPAPAPAPAP | 12,761 | PERV_Q4VFZ2_3mutA_WS |
| EAAAKEAAAKEAAAKEAAAKEAAAK | 12,762 | MLVMS_P03355_3mut |
| GSSGGSEAAAK | 12,763 | MLVMS_P03355_3mutA_WS |
| GGSGGSGGSGGS | 12,764 | WMSV_P03359_3mutA |
| EAAAKGSSGGG | 12,765 | WMSV_P03359_3mutA |
| EAAAKGGG | 12,766 | PERV_Q4VFZ2_3mutA_WS |
| SGSETPGTSESATPES | 12,767 | PERV_Q4VFZ2_3mut |
| PAPGSSGGS | 12,768 | MLVMS_P03355_3mutA_WS |
| PAPEAAAKGSS | 12,769 | PERV_Q4VFZ2_3mut |
| PAPEAAAK | 12,770 | AVIRE_P03360_3mutA |
| GSSEAAAKGGG | 12,771 | BAEVM_P10272_3mutA |
| GSSPAP | 12,772 | MLVAV_P03356_3mutA |
| EAAAKEAAAKEAAAKEAAAK | 12,773 | MLVFF_P26809_3mut |
| PAPGGSGSS | 12,774 | MLVAV_P03356_3mutA |
| GGGGSGGGGSGGGGS | 12,775 | PERV_Q4VFZ2_3mutA_WS |
| GSSGGSEAAAK | 12,776 | MLVCB_P08361_3mutA |
| EAAAKGGS | 12,777 | KORV_Q9TTC1-Pro_3mutA |
| EAAAKGGS | 12,778 | MLVFF_P26809_3mutA |
| GGSPAP | 12,779 | MLVMS_P03355_PLV919 |
| GGSGSS | 12,780 | MLVMS_P03355_PLV919 |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| SGSETPGTSESATPES | 12,781 | WMSV_P03359_3mut |
| GGGGGGG | 12,782 | WMSV_P03359_3mut |
| GGSPAPGSS | 12,783 | MLVCB_P08361_3mutA |
| GGGGSSGGS | 12,784 | WMSV_P03359_3mut |
| PAPGGS | 12,785 | MLVMS_P03355_PLV919 |
| PAPGSSGGS | 12,786 | MLVCB_P08361_3mutA |
| EAAAKEAAAKEAAAKEAAAKEAAAK | 12,787 | MLVFF_P26809_3mut |
| SGGSSGGSSGSETPGTSESATPESSGGSSGGSS | 12,788 | PERV_Q4VFZ2_3mut |
| GGSGGSGGSGGSGGS | 12,789 | BAEVM_P10272_3mutA |
| GSSEAAAK | 12,790 | PERV_Q4VFZ2_3mut |
| EAAAKEAAAKEAAAKEAAAK | 12,791 | KORV_Q9TTC1-Pro_3mutA |
| GGSGGSGGSGGSGGS | 12,792 | MLVMS_P03355_3mut |
| PAPAPAPAPAPAP | 12,793 | MLVMS_P03355_3mut |
| GGSPAPEAAAK | 12,794 | MLVMS_P03355_PLV919 |
| EAAAK | 12,795 | WMSV_P03359_3mutA |
| EAAAKGSSGGS | 12,796 | MLVBM_Q7SVK7_3mutA_WS |
| GGSGGGGSS | 12,797 | MLVMS_P03355_3mutA_WS |
| GGGEAAAKPAP | 12,798 | MLVMS_P03355_3mut |
| EAAAKGGSGGG | 12,799 | XMRV6_A1Z651_3mutA |
| GGGGGSEAAAK | 12,800 | KORV_Q9TTC1-Pro_3mutA |
| GGGGGG | 12,801 | BAEVM_P10272_3mutA |
| GGGGGG | 12,802 | MLVMS_P03355_3mut |
| GGGGGGG | 12,803 | MLVBM_Q7SVK7_3mutA_WS |
| AEAAAKEAAAKEAAAKEAAAKALEAEAAAKEAAAKEAAAKEAAAKA | 12,804 | AVIRE_P03360 |
| PAPGSSGGS | 12,805 | PERV_Q4VFZ2_3mut |
| GGGGGS | 12,806 | XMRV6_A1Z651_3mut |
| EAAAKPAP | 12,807 | XMRV6_A1Z651_3mutA |
| GGG | | MLVMS_P03355_3mutA_WS |
| AEAAAKEAAAKEAAAKEAAAKALEAEAAAKEAAAKEAAAKEAAAKA | 12,809 | FLV_P10273_3mut |
| EAAAKGSSPAP | 12,810 | MLVMS_P03355_3mut |
| SGSETPGTSESATPES | 12,811 | BAEVM_P10272_3mutA |
| GGSPAPEAAAK | 12,812 | MLVMS_P03355_3mut |
| GSSGSSGSSGSS | 12,813 | MLVAV_P03356_3mutA |
| AEAAAKEAAAKEAAAKEAAAKALEAEAAAKEAAAKEAAAKEAAAKA | 12,814 | MLVMS_P03355_3mut |
| GGSPAP | 12,815 | MLVCB_P08361_3mutA |
| GGGGGSEAAAK | 12,816 | MLVMS_P03355_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGG | 12,817 | MLVFF_P26809_3mutA |
| GSSEAAAK | 12,818 | MLVAV_P03356_3mutA |
| GGS | | BAEVM_P10272_3mut |
| EAAAKGGSPAP | 12,820 | MLVCB_P08361_3mutA |
| PAPAPAPAP | 12,821 | FLV_P10273_3mutA |
| PAPGGGEAAAK | 12,822 | MLVCB_P08361_3mutA |
| GGGGSSEAAAK | 12,823 | MLVMS_P03355_3mutA_WS |
| GGGGG | 12,824 | PERV_Q4VFZ2_3mutA_WS |
| GGSGGSGGSGGSGGSGGS | 12,825 | PERV_Q4VFZ2_3mut |
| GGGGG | 12,826 | MLVMS_P03355_3mut |
| PAPEAAAKGGG | 12,827 | MLVBM_Q7SVK7_3mutA_WS |
| GSSGGGPAP | 12,828 | XMRV6_A1Z651_3mutA |
| GSSGSSGSSGSSGSSGSS | 12,829 | PERV_Q4VFZ2_3mutA_WS |
| EAAAKGGSPAP | 12,830 | PERV_Q4VFZ2_3mut |
| GSSGGSEAAAK | 12,831 | MLVMS_P03355_PLV919 |
| GSS | | PERV_Q4VFZ2_3mut |
| EAAAKGGS | 12,833 | WMSV_P03359_3mutA |
| GGGGGSPAP | 12,834 | PERV_Q4VFZ2_3mutA_WS |
| EAAAKGSS | 12,835 | MLVMS_P03355_PLV919 |
| EAAAKGGGGSS | 12,836 | KORV_Q9TTC1-Pro_3mutA |
| PAPGSSGGG | 12,837 | PERV_Q4VFZ2_3mut |
| GGGGSSEAAAK | 12,838 | MLVFF_P26809_3mut |
| PAPAPAP | 12,839 | MLVMS_P03355_3mut |
| GSSGGSEAAAK | 12,840 | XMRV6_A1Z651_3mut |
| PAPEAAAKGSS | 12,841 | MLVMS_P03355_3mutA_WS |
| GGSGGSGGSGGSGGS | 12,842 | MLVMS_P03355_3mutA_WS |
| GGSGSSPAP | 12,843 | XMRV6_A1Z651_3mutA |
| GGGGSSPAP | 12,844 | MLVMS_P03355_PLV919 |
| GGGGS | 12,845 | MLVCB_P08361_3mutA |
| EAAAKEAAAKEAAAKEAAAK | 12,846 | PERV_Q4VFZ2_3mutA_WS |
| EAAAKEAAAK | 12,847 | KORV_Q9TTC1_3mutA |
| PAPGGGEAAAK | 12,848 | BAEVM_P10272_3mutA |
| GSSGGSEAAAK | 12,849 | XMRV6_A1Z651_3mutA |
| EAAAKEAAAKEAAAKEAAAKEAAAKEAAAK | 12,850 | FLV_P10273_3mut |
| GSSEAAAKPAP | 12,851 | MLVMS_P03355_3mutA_WS |
| EAAAKPAPGSS | 12,852 | PERV_Q4VFZ2_3mutA_WS |
| GSSGGSPAP | 12,853 | XMRV6_A1Z651_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSEAAAKGGG | 12,854 | PERV_Q4VFZ2_3mut |
| GGGEAAAKGGS | 12,855 | WMSV_P03359_3mutA |
| GSSEAAAKGGG | 12,856 | MLVFF_P26809_3mut |
| PAPAPAP | 12,857 | KORV_Q9TTC1-Pro_3mutA |
| EAAAKGGSPAP | 12,858 | MLVMS_P03355_3mutA_WS |
| PAPGGSEAAAK | 12,859 | PERV_Q4VFZ2_3mut |
| GGGGS | 12,860 | MLVBM_Q7SVK7_3mutA_WS |
| EAAAKGSSGGG | 12,861 | KORV_Q9TTC1_3mut |
| EAAAKGGGPAP | 12,862 | MLVCB_P08361_3mutA |
| EAAAKGSS | 12,863 | BAEVM_P10272_3mutA |
| GGSPAPGGG | 12,864 | MLVBM_Q7SVK7_3mutA_WS |
| GGGGSEAAAKGGGGS | 12,865 | MLVMS_P03355_3mutA_WS |
| GGGEAAAKGGS | 12,866 | PERV_Q4VFZ2_3mutA_WS |
| EAAAKGGGGSS | 12,867 | MLVMS_P03355_3mutA_WS |
| EAAAKGGGPAP | 12,868 | MLVFF_P26809_3mut |
| GSSPAP | 12,869 | PERV_Q4VFZ2_3mutA_WS |
| EAAAKGGS | 12,870 | MLVMS_P03355_3mut |
| GGGGSS | 12,871 | KORV_Q9TTC1-Pro_3mutA |
| EAAAKGSSPAP | 12,872 | MLVMS_P03355_3mutA_WS |
| GGGPAP | 12,873 | PERV_Q4VFZ2_3mut |
| EAAAKGSSGGS | 12,874 | XMRV6_A1Z651_3mutA |
| PAPGGG | 12,875 | MLVAV_P03356_3mutA |
| GSSPAPEAAAK | 12,876 | BAEVM_P10272_3mutA |
| GGGPAP | 12,877 | MLVBM_Q7SVK7_3mutA_WS |
| GSSGGGGS | 12,878 | AVIRE_P03360_3mutA |
| SGSETPGTSESATPES | 12,879 | MLVMS_P03355_PLV919 |
| GGGPAP | 12,880 | MLVFF_P26809_3mut |
| EAAAKGGGGSS | 12,881 | XMRV6_A1Z651_3mutA |
| GGGGSSPAP | 12,882 | XMRV6_A1Z651_3mut |
| GGGGSEAAAKGGGGS | 12,883 | MLVMS_P03355_3mut |
| GSSPAP | 12,884 | MLVBM_Q7SVK7_3mutA_WS |
| GGSGSSEAAAK | 12,885 | FLV_P10273_3mutA |
| SGSETPGTSESATPES | 12,886 | MLVBM_Q7SVK7_3mutA_WS |
| PAPGGG | 12,887 | AVIRE_P03360_3mutA |
| GGGEAAAKPAP | 12,888 | MLVMS_P03355_3mutA_WS |
| EAAAKGGSGSS | 12,889 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSPAPGGG | 12,890 | MLVAV_P03356_3mutA |
| PAPGGSGSS | 12,891 | BAEVM_P10272_3mutA |
| GSSGGSPAP | 12,892 | MLVFF_P26809_3mutA |
| EAAAKGSSGGG | 12,893 | PERV_Q4VFZ2_3mut |
| GGGGSGGGGS | 12,894 | PERV_Q4VFZ2_3mutA_WS |
| GSSGGGGGS | 12,895 | BAEVM_P10272_3mutA |
| GGGGSSGGS | 12,896 | MLVBM_Q7SVK7_3mutA_WS |
| EAAAKGGS | 12,897 | PERV_Q4VFZ2_3mutA_WS |
| GSSGSSGSSGSS | 12,898 | MLVMS_P03355_3mut |
| GGS |  | MLVMS_P03355_3mutA_WS |
| GSSGGSEAAAK | 12,900 | MLVBM_Q7SVK7_3mutA_WS |
| SGGSSGGSSGSETPGTSESATPESSGGSSGGSS | 12,901 | XMRV6_A1Z651 |
| GGGGG | 12,902 | FLV_P10273_3mutA |
| PAPEAAAKGSS | 12,903 | PERV_Q4VFZ2_3mut |
| GGGGGG | 12,904 | WMSV_P03359_3mut |
| EAAAKGGG | 12,905 | BAEVM_P10272_3mutA |
| GGGGSS | 12,906 | MLVMS_P03355_3mutA_WS |
| GSSGGGEAAAK | 12,907 | KORV_Q9TTC1_3mut |
| GGSGSS | 12,908 | AVIRE_P03360_3mutA |
| EAAAKPAP | 12,909 | MLVMS_P03355_3mut |
| EAAAKEAAAKEAAAK | 12,910 | FLV_P10273_3mutA |
| GGGG | 12,911 | XMRV6_A1Z651_3mutA |
| GSSPAPGGS | 12,912 | BAEVM_P10272_3mutA |
| GSSGGGGS | 12,913 | MLVFF_P26809_3mutA |
| GGGGSSGGS | 12,914 | MLVAV_P03356_3mutA |
| GGS |  | PERV_Q4VFZ2_3mut |
| GGGGG | 12,916 | WMSV_P03359_3mutA |
| GSSGSSGSSGSSGSSGSS | 12,917 | FLV_P10273_3mutA |
| PAPGGGGSS | 12,918 | MLVAV_P03356_3mutA |
| GGGGGGG | 12,919 | BAEVM_P10272_3mutA |
| SGSETPGTSESATPES | 12,920 | MLVCB_P08361_3mutA |
| PAPGGG | 12,921 | BAEVM_P10272_3mutA |
| GSSGSSGSS | 12,922 | MLVCB_P08361_3mutA |
| GGSGSS | 12,923 | MLVMS_P03355_3mutA_WS |
| EAAAKGGGGSEAAAK | 12,924 | WMSV_P03359_3mutA |
| GGGGGGGG | 12,925 | FLV_P10273_3mutA |
| GSSGSS | 12,926 | MLVMS_P03355_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPEAAAKGGS | 12,927 | XMRV6_A1Z651_3mutA |
| EAAAKEAAAK | 12,928 | MLVMS_P03355_3mut |
| GGGGSGGGGSGGGGS | 12,929 | BAEVM_P10272_3mutA |
| EAAAKGSSPAP | 12,930 | MLVMS_P03355_PLV919 |
| GGGGSSEAAAK | 12,931 | MLVMS_P03355_3mut |
| GGGGSSEAAAK | 12,932 | BAEVM_P10272_3mutA |
| PAPGGSGSS | 12,933 | PERV_Q4VFZ2_3mut |
| GGSGGGEAAAK | 12,934 | MLVFF_P26809_3mut |
| PAPEAAAKGGS | 12,935 | PERV_Q4VFZ2_3mut |
| GGGPAPGSS | 12,936 | AVIRE_P03360_3mut |
| PAPGGSGGG | 12,937 | PERV_Q4VFZ2_3mutA_WS |
| GGGGGGGG | 12,938 | PERV_Q4VFZ2_3mutA_WS |
| GSSEAAAK | 12,939 | MLVMS_P03355_3mutA_WS |
| GGGGSGGGGSGGGGS | 12,940 | PERV_Q4VFZ2_3mutA_WS |
| EAAAKGGS | 12,941 | MLVMS_P03355_3mut |
| GGGGGSGSS | 12,942 | MLVCB_P08361_3mut |
| GGGPAP | 12,943 | KORV_Q9TTC1-Pro_3mutA |
| EAAAKPAPGGG | 12,944 | MLVCB_P08361_3mut |
| GSSGGSPAP | 12,945 | MLVCB_P08361_3mutA |
| SGGSSGGSSGSETPGTSESATPESSGGSSGGSS | 12,946 | MLVMS_P03355_3mut |
| PAPAPAPAP | 12,947 | MLVMS_P03355_3mut |
| GSSGGS | 12,948 | XMRV6_A1Z651_3mutA |
| GSSEAAAKGGG | 12,949 | MLVMS_P03355_3mut |
| GGSGSSPAP | 12,950 | MLVMS_P03355_3mutA_WS |
| GSSEAAAKGGS | 12,951 | MLVMS_P03355_PLV919 |
| EAAAKEAAAKEAAAKEAAAKEAAAK | 12,952 | BAEVM_P10272_3mut |
| PAPGGGGSS | 12,953 | KORV_Q9TTC1_3mutA |
| EAAAKGSS | 12,954 | MLVMS_P03355_3mutA_WS |
| AEAAAKEAAAKEAAAKEAAAKALEAEAAAKEAAAKEAAAKEAAAKA | 12,955 | FFV_093209_2mut |
| GGSGGSGGSGGSGGSGGS | 12,956 | BAEVM_P10272_3mutA |
| GGGGGG | 12,957 | MLVMS_P03355_PLV919 |
| PAPEAAAK | 12,958 | BAEVM_P10272_3mut |
| GGSGSSEAAAK | 12,959 | MLVAV_P03356_3mutA |
| GGG | | MLVCB_P08361_3mutA |
| GGGGG | 12,961 | MLVCB_P08361_3mutA |
| GGSGGSGGSGGS | 12,962 | KORV_Q9TTC1-Pro_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGSSGSSGSSGSSGSS | 12,963 | XMRV6_A1Z651_3mutA |
| GSSEAAAKPAP | 12,964 | FLV_P10273_3mutA |
| GGGEAAAKPAP | 12,965 | MLVCB_P08361_3mutA |
| GSSGSSGSS | 12,966 | MLVMS_P03355_3mutA_WS |
| PAPAPAPAP | 12,967 | MLVMS_P03355_PLV919 |
| EAAAKGGG | 12,968 | MLVMS_P03355_PLV919 |
| PAPAPAPAPAPAP | 12,969 | FLV_P10273_3mutA |
| EAAAKGGSGSS | 12,970 | MLVMS_P03355_3mut |
| GGGGGG | 12,971 | PERV_Q4VFZ2_3mutA_WS |
| PAPGGG | 12,972 | MLVCB_P08361_3mutA |
| GGGGGSGSS | 12,973 | KORV_Q9TTC1_3mutA |
| GGGGSGGGGSGGGGSGGGGS | 12,974 | XMRV6_A1Z651_3mut |
| GGSGGSGGS | 12,975 | KORV_Q9TTC1-Pro_3mutA |
| EAAAKPAPGGG | 12,976 | MLVMS_P03355_3mutA_WS |
| AEAAAKEAAAKEAAAKEAAAKALEAEAAAKEAAAKEAAAKEAAAKA | 12,977 | XMRV6_A1Z651 |
| GGGGSGGGGSGGGGSGGGGSGGGGSGGGGS | 12,978 | FLV_P10273_3mutA |
| EAAAKGGGGSEAAAK | 12,979 | PERV_Q4VFZ2_3mutA_WS |
| GGGPAPGSS | 12,980 | AVIRE_P03360_3mutA |
| GGGGG | 12,981 | MLVMS_P03355_3mutA_WS |
| GGGGSGGGGSGGGGSGGGGSGGGGSGGGGSGGGGS | 12,982 | MLVMS_P03355_3mut |
| GGGGSGGGGS | 12,983 | MLVMS_P03355_3mutA_WS |
| EAAAKGGSPAP | 12,984 | XMRV6_A1Z651_3mut |
| EAAAKGSSPAP | 12,985 | AVIRE_P03360_3mutA |
| PAPGGSGSS | 12,986 | KORV_Q9TTC1-Pro_3mutA |
| GSS | | MLVBM_Q7SVK7_3mutA_WS |
| GSS | | WMSV_P03359_3mut |
| GGGPAPGSS | 12,989 | MLVFF_P26809_3mutA |
| EAAAKPAP | 12,990 | MLVMS_P03355_3mut |
| GSSPAPEAAAK | 12,991 | FLV_P10273_3mutA |
| GGSPAPGSS | 12,992 | MLVBM_Q7SVK7_3mutA_WS |
| GGGGGSEAAAK | 12,993 | XMRV6_A1Z651_3mut |
| PAPEAAAKGGG | 12,994 | WMSV_P03359_3mutA |
| PAPGGG | 12,995 | PERV_Q4VFZ2_3mut |
| GGSPAPEAAAK | 12,996 | WMSV_P03359_3mutA |
| GGSGGGGSS | 12,997 | PERV_Q4VFZ2_3mut |
| EAAAKGGGGSS | 12,998 | PERV_Q4VFZ2_3mut |
| EAAAKGGSPAP | 12,999 | AVIRE_P03360_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSGGGGSS | 13,000 | WMSV_P03359_3mutA |
| PAPGSSEAAAK | 13,001 | MLVFF_P26809_3mut |
| GSSEAAAK | 13,002 | MLVMS_P03355_PLV919 |
| GSAGSAAGSGEF | 13,003 | AVIRE_P03360_3mutA |
| EAAAKGGSGSS | 13,004 | MLVMS_P03355_3mut |
| GGSEAAAKPAP | 13,005 | MLVMS_P03355_PLV919 |
| GGGGSGGGGSGGGGSGGGGSGGGGS | 13,006 | MLVFF_P26809_3mutA |
| PAPGSSEAAAK | 13,007 | PERV_Q4VFZ2_3mutA_WS |
| GGGGSSPAP | 13,008 | MLVMS_P03355_3mutA_WS |
| PAPAPAP | 13,009 | MLVCB_P08361_3mutA |
| EAAAKPAPGGG | 13,010 | MLVBM_Q7SVK7_3mutA_WS |
| GGGPAPGSS | 13,011 | BAEVM_P10272_3mutA |
| PAP | | MLVMS_P03355_3mutA_WS |
| PAPGGSGGG | 13,013 | MLVMS_P03355_3mutA_WS |
| GGSGGSGGSGGSGGS | 13,014 | MLVBM_Q7SVK7_3mutA_WS |
| PAPAPAPAP | 13,015 | XMRV6_A1Z651_3mut |
| GSSPAPGGG | 13,016 | MLVMS_P03355_3mutA_WS |
| GSSPAPGGG | 13,017 | MLVMS_P03355_3mut |
| PAPGGG | 13,018 | MLVMS_P03355_PLV919 |
| GGGEAAAKGSS | 13,019 | WMSV_P03359_3mut |
| EAAAKGSS | 13,020 | KORV_Q9TTC1-Pro_3mutA |
| EAAAKGGS | 13,021 | PERV_Q4VFZ2_3mut |
| EAAAKEAAAKEAAAKEAAAKEAAAK | 13,022 | PERV_Q4VFZ2_3mut |
| PAPEAAAKGGG | 13,023 | MLVMS_P03355_PLV919 |
| EAAAKGSSGGG | 13,024 | MLVFF_P26809_3mut |
| AEAAAKEAAAKEAAAKEAAAKALEAEAAAKEAAAKEAAAKEAAAKA | 13,025 | PERV_Q4VFZ2 |
| EAAAKEAAAKEAAAKEAAAKEAAAKEAAAK | 13,026 | MLVAV_P03356_3mutA |
| GSSGGSGGG | 13,027 | MLVFF_P26809_3mut |
| GSSGSSGSSGSS | 13,028 | PERV_Q4VFZ2_3mutA_WS |
| GGSPAPGGG | 13,029 | MLVMS_P03355_PLV919 |
| GSS | | BAEVM_P10272_3mut |
| GGGPAPGSS | 13,031 | MLVMS_P03355_3mutA_WS |
| GGGGSS | 13,032 | KORV_Q9TTC1_3mutA |
| GSSGGSGGG | 13,033 | BAEVM_P10272_3mutA |
| EAAAKEAAAKEAAAK | 13,034 | MLVCB_P08361_3mutA |
| SGGSSGGSSGSETPGTSESATPESSGGSSGGSS | 13,035 | FLV_P10273_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGGGGGS | 13,036 | PERV_Q4VFZ2_3mut |
| PAPAPAPAPAP | 13,037 | KORV_Q9TTC1-Pro_3mutA |
| EAAAK | 13,038 | MLVMS_P03355_3mutA_WS |
| GGG | | MLVCB_P08361_3mut |
| GGSEAAAKGGG | 13,040 | BAEVM_P10272_3mutA |
| GGGGGSGSS | 13,041 | MLVAV_P03356_3mutA |
| EAAAKGSSPAP | 13,042 | MLVBM_Q7SVK7_3mutA_WS |
| GGSGGSGGS | 13,043 | XMRV6_A1Z651_3mut |
| EAAAKPAPGGG | 13,044 | KORV_Q9TTC1-Pro_3mutA |
| GGGPAPEAAAK | 13,045 | FLV_P10273_3mutA |
| GGSPAPEAAAK | 13,046 | MLVMS_P03355_3mutA_WS |
| GGSGGSGGSGGSGGS | 13,047 | MLVFF_P26809_3mut |
| EAAAKGGSGSS | 13,048 | MLVMS_P03355_PLV919 |
| GGGEAAAKGGS | 13,049 | MLVBM_Q7SVK7_3mutA_WS |
| PAPAPAPAP | 13,050 | BAEVM_P10272_3mutA |
| EAAAKEAAAKEAAAKEAAAK | 13,051 | MLVMS_P03355_3mut |
| EAAAKPAP | 13,052 | XMRV6_A1Z651_3mut |
| EAAAKEAAAK | 13,053 | MLVBM_Q7SVK7_3mutA_WS |
| EAAAKGGG | 13,054 | BAEVM_P10272_3mut |
| EAAAKGSS | 13,055 | MLVAV_P03356_3mutA |
| EAAAKEAAAKEAAAKEAAAKEAAAK | 13,056 | MLVFF_P26809_3mut |
| GGGPAPGSS | 13,057 | PERV_Q4VFZ2_3mutA_WS |
| GGGG | 13,058 | PERV_Q4VFZ2_3mut |
| EAAAKGGSGSS | 13,059 | MLVMS_P03355_PLV919 |
| GGGGSGGGSGGGGS | 13,060 | MLVMS_P03355_3mutA_WS |
| EAAAK | 13,061 | MLVMS_P03355_3mutA_WS |
| GGGGSS | 13,062 | PERV_Q4VFZ2 |
| PAPEAAAKGGS | 13,063 | MLVCB_P08361_3mut |
| GSS | | MLVMS_P03355_3mut |
| GSAGSAAGSGEF | 13,065 | MLVFF_P26809_3mutA |
| EAAAKEAAAKEAAAKEAAAKEAAAK | 13,066 | KORV_Q9TTC1-Pro_3mut |
| GGGGSGGGGS | 13,067 | AVIRE_P03360_3mutA |
| EAAAK | 13,068 | MLVMS_P03355_3mut |
| GGGPAPGGS | 13,069 | PERV_Q4VFZ2_3mut |
| GGGGSGGGGSGGGGS | 13,070 | MLVMS_P03355_PLV919 |
| PAPGGG | 13,071 | MLVMS_P03355_3mutA_WS |
| GGGEAAAKPAP | 13,072 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKPAPGSS | 13,073 | KORV_Q9TTC1-Pro_3mutA |
| PAPGSS | 13,074 | KORV_Q9TTC1_3mutA |
| GSAGSAAGSGEF | 13,075 | PERV_Q4VFZ2_3mut |
| PAPGGGGSS | 13,076 | KORV_Q9TTC1-Pro_3mutA |
| GSSGGGEAAAK | 13,077 | MLVCB_P08361_3mutA |
| GSS | | AVIRE_P03360_3mutA |
| GSSGSSGSSGSS | 13,079 | XMRV6_A1Z651_3mutA |
| PAPEAAAKGGG | 13,080 | MLVMS_P03355_PLV919 |
| GGGPAPEAAAK | 13,081 | MLVCB_P08361_3mutA |
| PAPGGGGS | 13,082 | MLVCB_P08361_3mutA |
| EAAAKEAAAKEAAAKEAAAK | 13,083 | PERV_Q4VFZ2_3mutA_WS |
| GGGGGSPAP | 13,084 | MLVFF_P26809_3mutA |
| GSSGSSGSSGSSGSS | 13,085 | PERV_Q4VFZ2 |
| GSSPAPEAAAK | 13,086 | MLVMS_P03355_PLV919 |
| GSSGSSGSSGSSGSSGSS | 13,087 | MLVBM_Q7SVK7_3mutA_WS |
| GSSGSSGSSGSSGSSGSS | 13,088 | MLVMS_P03355_3mutA_WS |
| GGSPAPEAAAK | 13,089 | MLVAV_P03356_3mutA |
| GSSGGG | 13,090 | BAEVM_P10272_3mut |
| EAAAKGSSGGS | 13,091 | KORV_Q9TTC1-Pro_3mutA |
| GGSGSSEAAAK | 13,092 | MLVMS_P03355_3mutA_WS |
| GGGPAPEAAAK | 13,093 | MLVFF_P26809_3mutA |
| GGGPAPGGS | 13,094 | MLVMS_P03355_3mutA_WS |
| GGGGG | 13,095 | MLVMS_P03355_PLV919 |
| GGGEAAAKPAP | 13,096 | MLVBM_Q7SVK7_3mutA_WS |
| GGGGSGGGGS | 13,097 | WMSV_P03359_3mut |
| GGGPAPEAAAK | 13,098 | PERV_Q4VFZ2_3mut |
| GGSGSSEAAAK | 13,099 | MLVMS_P03355_PLV919 |
| EAAAKGGGPAP | 13,100 | MLVMS_P03355_3mutA_WS |
| GSSGSSGSSGSSGSS | 13,101 | KORV_Q9TTC1-Pro_3mutA |
| PAPAP | 13,102 | WMSV_P03359_3mutA |
| GGSPAPGSS | 13,103 | MLVAV_P03356_3mutA |
| GGSGGGPAP | 13,104 | MLVMS_P03355_3mut |
| GGSPAP | 13,105 | MLVMS_P03355_PLV919 |
| EAAAKGGSPAP | 13,106 | PERV_Q4VFZ2_3mut |
| GSSPAPGGG | 13,107 | KORV_Q9TTC1-Pro_3mutA |
| GSAGSAAGSGEF | 13,108 | MLVMS_P03355_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGSPAP | 13,109 | PERV_Q4VFZ2_3mut |
| GSSGSS | 13,110 | KORV_Q9TTC1-Pro_3mut |
| GGGPAPGSS | 13,111 | MLVMS_P03355_3mutA_WS |
| AEAAAKEAAAKEAAAKEAAAKALEAEAAAKEAAAKEAAAKEAAAKA | 13,112 | FOAMV_P14350 |
| PAPGSSGGG | 13,113 | MLVMS_P03355_PLV919 |
| GGSEAAAKPAP | 13,114 | BAEVM_P10272_3mutA |
| GGGGGS | 13,115 | MLVCB_P08361_3mutA |
| PAPEAAAKGGS | 13,116 | MLVMS_P03355_3mutA_WS |
| EAAAKEAAAKEAAAKEAAAKEAAAKEAAK | 13,117 | BAEVM_P10272_3mutA |
| GGSEAAAK | 13,118 | BAEVM_P10272_3mutA |
| GSSPAPEAAAK | 13,119 | MLVMS_P03355_3mutA_WS |
| PAPGGG | 13,120 | WMSV_P03359_3mut |
| EAAAKPAP | 13,121 | PERV_Q4VFZ2_3mut |
| GSSGSSGSSGSSGSS | 13,122 | WMSV_P03359_3mut |
| PAPGGG | 13,123 | MLVBM_Q7SVK7_3mutA_WS |
| GGSGGGEAAAK | 13,124 | BAEVM_P10272_3mutA |
| PAPGGS | 13,125 | MLVMS_P03355_3mut |
| GGSGGSGGSGGS | 13,126 | MLVBM_Q7SVK7_3mutA_WS |
| EAAAKEAAAKEAAAKEAAAK | 13,127 | PERV_Q4VFZ2_3mut |
| GGSEAAAKGGG | 13,128 | WMSV_P03359_3mutA |
| GGGPAP | 13,129 | BAEVM_P10272_3mutA |
| GGGGGGGGSGGGGSGGGGSGGGGSGGGGS | 13,130 | XMRV6_A1Z651_3mut |
| GGSPAPGSS | 13,131 | KORV_Q9TTC1_3mut |
| GGGPAPGSS | 13,132 | MLVMS_P03355_3mut |
| GGGGSSGGS | 13,133 | BAEVM_P10272_3mutA |
| GGGEAAAKGSS | 13,134 | KORV_Q9TTC1-Pro_3mutA |
| PAPAP | 13,135 | MLVBM_Q7SVK7_3mutA_WS |
| GGSPAPGGG | 13,136 | PERV_Q4VFZ2_3mut |
| PAPGSS | 13,137 | PERV_Q4VFZ2_3mutA_WS |
| GSSGGSPAP | 13,138 | MLVBM_Q7SVK7_3mutA_WS |
| EAAAKGGGSEAAAK | 13,139 | PERV_Q4VFZ2_3mut |
| GSSEAAAKGGS | 13,140 | KORV_Q9TTC1-Pro_3mut |
| PAPAPAPAP | 13,141 | KORV_Q9TTC1-Pro_3mutA |
| GGSEAAAKPAP | 13,142 | WMSV_P03359_3mutA |
| PAPGGS | 13,143 | FLV_P10273_3mutA |
| EAAAKGGGPAP | 13,144 | PERV_Q4VFZ2_3mut |
| GGSGSSGGG | 13,145 | AVIRE_P03360_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGGSGSS | 13,146 | BAEVM_P10272_3mutA |
| SGGSSGGSSGSETPGTSESATPESSGGSSGGSS | 13,147 | MLVCB_P08361_3mutA |
| GSSEAAAKGGS | 13,148 | XMRV6_A1Z651_3mutA |
| GGGGG | 13,149 | BAEVM_P10272_3mutA |
| GGGGSGGGGSGGGGSGGGGSGGGGSGGGGS | 13,150 | SFV3L_P27401_2mutA |
| GGGEAAAKGSS | 13,151 | MLVMS_P03355_PLV919 |
| EAAAKGGGGSEAAAK | 13,152 | KORV_Q9TTC1_3mutA |
| EAAAKGGG | 13,153 | AVIRE_P03360_3mut |
| GGSGGG | 13,154 | MLVMS_P03355_3mutA_WS |
| GGSGSSGGG | 13,155 | MLVMS_P03355_PLV919 |
| GGGGSGGGGSGGGGSGGGGSGGGGSGGGGS | 13,156 | KORV_Q9TTC1_3mut |
| GGGGSEAAAKGGGGS | 13,157 | KORV_Q9TTC1_3mutA |
| PAPAPAPAPAP | 13,158 | FLV_P10273_3mutA |
| GGS | | MLVBM_Q7SVK7_3mutA_WS |
| GGGGGSEAAAK | 13,160 | MLVBM_Q7SVK7_3mutA_WS |
| GSSGSSGSSGSSGSS | 13,161 | MLVMS_P03355_3mutA_WS |
| EAAAKEAAAKEAAAKEAAAKEAAAK | 13,162 | MLVMS_P03355_3mut |
| GGSGSSGGG | 13,163 | PERV_Q4VFZ2_3mut |
| PAP | | MLVFF_P26809_3mut |
| GSSPAPEAAAK | 13,165 | MLVAV_P03356_3mutA |
| EAAAKGGGGSS | 13,166 | MLVMS_P03355_3mut |
| GGGEAAAKGGS | 13,167 | XMRV6_A1Z651_3mut |
| GGSGGGPAP | 13,168 | MLVBM_Q7SVK7_3mutA_WS |
| GSAGSAAGSGEF | 13,169 | BAEVM_P10272_3mutA |
| GSSEAAAK | 13,170 | MLVCB_P08361_3mut |
| PAPGSS | 13,171 | MLVMS_P03355_3mut |
| EAAAKEAAAKEAAAK | 13,172 | MLVAV_P03356_3mutA |
| GSAGSAAGSGEF | 13,173 | XMRV6_A1Z651_3mut |
| GSSGSSGSSGSS | 13,174 | BAEVM_P10272_3mutA |
| AEAAAKEAAAKEAAAKEAAAKALEAEAAAKEAAAKEAAAKEAAAKA | 13,175 | KORV_Q9TTC1-Pro_3mut |
| GGGGSSEAAAK | 13,176 | WMSV_P03359_3mut |
| GSSGGGEAAAK | 13,177 | MLVBM_Q7SVK7_3mutA_WS |
| EAAAKPAP | 13,178 | MLVFF_P26809_3mutA |
| GGSPAPGGG | 13,179 | KORV_Q9TTC1_3mutA |
| PAPEAAAK | 13,180 | FLV_P10273_3mutA |
| GSSGSSGSS | 13,181 | MLVBM_Q7SVK7_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGGEAAAK | 13,182 | FLV_P10273_3mutA |
| GGSPAP | 13,183 | MLVBM_Q7SVK7_3mutA_WS |
| GSAGSAAGSGEF | 13,184 | KORV_Q9TTC1-Pro_3mutA |
| PAPGGSEAAAK | 13,185 | MLVMS_P03355_PLV919 |
| GGSPAPEAAAK | 13,186 | MLVBM_Q7SVK7_3mutA_WS |
| GGGGGSPAP | 13,187 | MLVBM_Q7SVK7_3mutA_WS |
| EAAAKGSSPAP | 13,188 | WMSV_P03359_3mut |
| EAAAKGGGPAP | 13,189 | MLVBM_Q7SVK7_3mutA_WS |
| PAPGSS | 13,190 | KORV_Q9TTC1-Pro_3mutA |
| GGSGSSGGG | 13,191 | BAEVM_P10272_3mut |
| SGGSSGGSSGSETPGTSESATPESSGGSSGGSS | 13,192 | FFV_O93209-Pro_2mut |
| GGSGGSGGSGGSGGSGGS | 13,193 | WMSV_P03359_3mutA |
| GGSGGSGGS | 13,194 | PERV_Q4VFZ2_3mutA_WS |
| GGGGG | 13,195 | PERV_Q4VFZ2_3mutA_WS |
| GGGPAP | 13,196 | FLV_P10273_3mutA |
| PAPGGSGGG | 13,197 | XMRV6_A1Z651_3mutA |
| GGGGSEAAAKGGGGS | 13,198 | XMRV6_A1Z651_3mut |
| EAAAKGSSGGG | 13,199 | KORV_Q9TTC1-Pro_3mutA |
| GSSGGSEAAAK | 13,200 | WMSV_P03359_3mut |
| EAAAKGGSGSS | 13,201 | PERV_Q4VFZ2_3mut |
| PAPAPAPAPAP | 13,202 | PERV_Q4VFZ2_3mut |
| GGGGSGGGGSGGGGSGGGGSGGGGSGGGGS | 13,203 | MLVMS_P03355_3mutA_WS |
| GGGGGGG | 13,204 | KORV_Q9TTC1_3mutA |
| EAAAK | 13,205 | KORV_Q9TTC1-Pro_3mutA |
| GGGEAAAKGGS | 13,206 | KORV_Q9TTC1-Pro_3mutA |
| GGGEAAAKGGS | 13,207 | PERV_Q4VFZ2_3mutA_WS |
| GGGGGSPAP | 13,208 | XMRV6_A1Z651_3mut |
| GGGGSGGGGSGGGGSGGGGS | 13,209 | MLVFF_P26809_3mut |
| GGGGGGG | 13,210 | MLVFF_P26809_3mut |
| PAPAPAPAPAPAP | 13,211 | AVIRE_P03360_3mutA |
| GSSPAPGGG | 13,212 | FLV_P10273_3mutA |
| GGGGGSPAP | 13,213 | MLVMS_P03355_3mutA_WS |
| GGGGSGGGGSGGGGS | 13,214 | MLVMS_P03355_3mut |
| GGGGSGGGGSGGGGS | 13,215 | KORV_Q9TTC1_3mut |
| GSSEAAAKGGS | 13,216 | MLVAV_P03356_3mutA |
| GSSGSSGSSGSSGSS | 13,217 | MLVMS_P03355_3mut |
| EAAAKGGGGS | 13,218 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGGGGS | 13,219 | PERV_Q4VFZ2_3mut |
| GGGEAAAKPAP | 13,220 | MLVMS_P03355_3mut |
| GSSGGSPAP | 13,221 | PERV_Q4VFZ2_3mutA_WS |
| GSSGGGPAP | 13,222 | BAEVM_P10272_3mutA |
| GGGGGSGSS | 13,223 | MLVMS_P03355_PLV919 |
| AEAAAKEAAAKEAAAKEAAAKALEAEAAAKEAAAKEAAAKEAAAKA | 13,224 | BAEVM_P10272_3mut |
| PAPEAAAK | 13,225 | MLVMS_P03355_3mut |
| GGGGSGGGGSGGGGS | 13,226 | FLV_P10273_3mutA |
| GGSGSSGGG | 13,227 | WMSV_P03359_3mutA |
| EAAAKGGS | 13,228 | PERV_Q4VFZ2_3mut |
| EAAAKGSSPAP | 13,229 | MLVCB_P08361_3mut |
| EAAAKGGSGSS | 13,230 | WMSV_P03359_3mutA |
| GSSGSS | 13,231 | PERV_Q4VFZ2_3mutA_WS |
| PAPAPAPAP | 13,232 | MLVMS_P03355_PLV919 |
| GGSGGG | 13,233 | PERV_Q4VFZ2_3mutA_WS |
| GSS |  | MLVBM_Q7SVK7_3mutA_WS |
| PAP |  | KORV_Q9TTC1-Pro_3mutA |
| GGSGSSEAAAK | 13,236 | MLVFF_P26809_3mut |
| PAPEAAAKGSS | 13,237 | KORV_Q9TTC1-Pro_3mutA |
| GGSGGS | 13,238 | MLVCB_P08361_3mutA |
| GGGGGGG | 13,239 | PERV_Q4VFZ2_3mutA_WS |
| GGSPAPEAAAK | 13,240 | MLVBM_Q7SVK7_3mut |
| EAAAKEAAAKEAAAKEAAAKEAAAK | 13,241 | KORV_Q9TTC1_3mutA |
| GGSPAP | 13,242 | MLVMS_P03355_3mut |
| GGSEAAAKGGG | 13,243 | PERV_Q4VFZ2_3mut |
| GGGGSGGGS | 13,244 | FLV_P10273_3mutA |
| GGGEAAAK | 13,245 | BAEVM_P10272_3mutA |
| GGGGSGGGGSGGGGSGGGGSGGGGSGGGGS | 13,246 | SFV3L_P27401_2mut |
| GGSEAAAKPAP | 13,247 | KORV_Q9TTC1-Pro_3mutA |
| GSSGGGEAAAK | 13,248 | MLVMS_P03355_PLV919 |
| GGGGSEAAAK | 13,249 | MLVMS_P03355_PLV919 |
| EAAAKGGSGGG | 13,250 | MLVMS_P03355_3mutA_WS |
| GGGGSSPAP | 13,251 | MLVAV_P03356_3mutA |
| EAAAKEAAAK | 13,252 | MLVMS_P03355_3mutA_WS |
| AEAAAKEAAAKEAAAKEAAAKALEAEAAAKEAAAKEAAAKEAAAKA | 13,253 | SFV3L_P27401_2mut |
| GSSGSSGSSGSSGSS | 13,254 | MLVMS_P03355_PLV919 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGG | 13,255 | KORV_Q9TTC1-Pro_3mutA |
| GSSGGS | 13,256 | MLVFF_P26809_3mutA |
| GGGGSGGGGS | 13,257 | XMRV6_A1Z651_3mutA |
| PAPGSS | 13,258 | MLVBM_Q7SVK7_3mutA_WS |
| GGGPAPEAAAK | 13,259 | XMRV6_A1Z651_3mutA |
| EAAAKGGS | 13,260 | MLVFF_P26809_3mut |
| GSS | | KORV_Q9TTC1_3mutA |
| GGGG | 13,262 | PERV_Q4VFZ2_3mut |
| GGGGGSEAAAK | 13,263 | AVIRE_P03360_3mutA |
| GSSGSSGSSGSSGSS | 13,264 | MLVMS_P03355_PLV919 |
| PAPGGSGGG | 13,265 | PERV_Q4VFZ2_3mut |
| GGGPAP | 13,266 | PERV_Q4VFZ2_3mut |
| GGGPAPEAAAK | 13,267 | AVIRE_P03360_3mutA |
| GGGEAAAK | 13,268 | MLVCB_P08361_3mut |
| GGG | | MLVFF_P26809_3mutA |
| EAAAKPAPGSS | 13,270 | XMRV6_A1Z651_3mutA |
| GGSGSSEAAAK | 13,271 | PERV_Q4VFZ2_3mutA_WS |
| EAAAKGSS | 13,272 | MLVMS_P03355_3mut |
| GGSGSSEAAAK | 13,273 | BAEVM_P10272_3mut |
| GGSGGG | 13,274 | MLVBM_Q7SVK7_3mutA_WS |
| GGGPAP | 13,275 | MLVMS_P03355_PLV919 |
| GGSPAPGGG | 13,276 | PERV_Q4VFZ2_3mutA_WS |
| GGGGGSEAAAK | 13,277 | MLVFF_P26809_3mutA |
| EAAAKGSSGGS | 13,278 | MLVBM_Q7SVK7_3mut |
| PAPAP | 13,279 | XMRV6_A1Z651_3mut |
| GSSPAPGGS | 13,280 | MLVBM_Q7SVK7_3mutA_WS |
| GSSEAAAKGGG | 13,281 | WMSV_P03359_3mutA |
| EAAAKGGGGS | 13,282 | PERV_Q4VFZ2_3mut |
| GSSGSSGSSGSSGSS | 13,283 | MLVCB_P08361_3mutA |
| EAAAKGGGGSS | 13,284 | PERV_Q4VFZ2_3mut |
| EAAAKGSS | 13,285 | PERV_Q4VFZ2_3mut |
| EAAAKEAAAKEAAAKEAAAKEAAAKEAAAK | 13,286 | AVIRE_P03360_3mutA |
| EAAAKGGS | 13,287 | MLVCB_P08361_3mut |
| GSSGGSEAAAK | 13,288 | MLVAV_P03356_3mutA |
| EAAAKPAPGGS | 13,289 | PERV_Q4VFZ2_3mut |
| GGSGGS | 13,290 | MLVAV_P03356_3mutA |
| EAAAKGSSGGG | 13,291 | AVIRE_P03360_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGSGGSGGSGGS | 13,292 | PERV_Q4VFZ2_3mut |
| GGGGGGGG | 13,293 | KORV_Q9TTC1_3mutA |
| GGSGSSEAAAK | 13,294 | MLVCB_P08361_3mutA |
| EAAAKGGG | 13,295 | MLVBM_Q7SVK7_3mutA_WS |
| GGGGGGGSGGGGS | 13,296 | MLVCB_P08361_3mut |
| GGSGGSGGSGGS | 13,297 | PERV_Q4VFZ2_3mutA_WS |
| PAPAPAPAPAP | 13,298 | WMSV_P03359_3mut |
| EAAAKEAAAKEAAAKEAAAK | 13,299 | PERV_Q4VFZ2_3mut |
| GGSGGSGGS | 13,300 | XMRV6_A1Z651_3mutA |
| PAPGGGGSS | 13,301 | BAEVM_P10272_3mutA |
| GSSEAAAKGGS | 13,302 | MLVCB_P08361_3mut |
| GSSGGGPAP | 13,303 | MLVCB_P08361_3mutA |
| GGSGSS | 13,304 | MLVBM_Q7SVK7_3mutA_WS |
| GGGGGSEAAAK | 13,305 | MLVAV_P03356_3mutA |
| GSSEAAAK | 13,306 | PERV_Q4VFZ2_3mutA_WS |
| GGGGGSGSS | 13,307 | MLVBM_Q7SVK7_3mutA_WS |
| EAAAKGGSGSS | 13,308 | MLVFF_P26809_3mut |
| PAP |  | FLV_P10273_3mutA |
| GGGGG | 13,310 | MLVMS_P03355_3mutA_WS |
| EAAAK | 13,311 | PERV_Q4VFZ2_3mut |
| GSS |  | FLV_P10273_3mutA |
| PAPAPAPAPAPAP | 13,313 | KORV_Q9TTC1-Pro_3mutA |
| EAAAKEAAAKEAAAKEAAAK | 13,314 | MLVCB_P08361_3mut |
| EAAAKGGGGSEAAAK | 13,315 | XMRV6_A1Z651_3mut |
| PAPGGSGGG | 13,316 | MLVBM_Q7SVK7_3mutA_WS |
| GGSGGGPAP | 13,317 | WMSV_P03359_3mutA |
| GGGGSSEAAAK | 13,318 | MLVBM_Q7SVK7_3mutA_WS |
| PAPGGGGSS | 13,319 | MLVCB_P08361_3mut |
| GGSGGSGGSGGS | 13,320 | PERV_Q4VFZ2_3mutA_WS |
| PAPGGSGGG | 13,321 | MLVMS_P03355_3mutA_WS |
| GSSPAPGGS | 13,322 | MLVCB_P08361_3mutA |
| GSSGSSGSS | 13,323 | MLVFF_P26809_3mut |
| PAPGGGGGS | 13,324 | MLVBM_Q7SVK7_3mutA_WS |
| GSSPAP | 13,325 | PERV_Q4VFZ2_3mut |
| GGSGGG | 13,326 | KORV_Q9TTC1-Pro_3mut |
| EAAAKGGGGSEAAAK | 13,327 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSPAPEAAAK | 13,328 | PERV_Q4VFZ2_3mutA_WS |
| EAAAKPAP | 13,329 | BAEVM_P10272_3mut |
| GGGGSGGGGSGGGGSGGGGSGGGGSGGGGS | 13,330 | MLVMS_P03355_3mut |
| EAAAKGGGGSS | 13,331 | MLVFF_P26809_3mut |
| EAAAKEAAAK | 13,332 | MLVCB_P08361_3mut |
| GSSEAAAKGGS | 13,333 | PERV_Q4VFZ2_3mut |
| GGSPAP | 13,334 | KORV_Q9TTC1-Pro_3mutA |
| EAAAKEAAAKEAAAKEAAAK | 13,335 | MLVMS_P03355_3mutA_WS |
| GSSGSSGSSGSSGSS | 13,336 | BAEVM_P10272_3mut |
| PAPEAAAK | 13,337 | MLVMS_P03355_3mut |
| GSSGGSPAP | 13,338 | PERV_Q4VFZ2 |
| GGGPAPGGS | 13,339 | BAEVM_P10272_3mutA |
| EAAAKPAPGGS | 13,340 | MLVMS_P03355_PLV919 |
| GGGGSGGGGS | 13,341 | PERV_Q4VFZ2 |
| GGGEAAAK | 13,342 | KORV_Q9TTC1-Pro_3mut |
| EAAAKGGGGS | 13,343 | FLV_P10273_3mutA |
| GGSPAPGSS | 13,344 | MLVMS_P03355_3mut |
| GSSPAPEAAAK | 13,345 | MLVMS_P03355_3mutA_WS |
| GSAGSAAGSGEF | 13,346 | MLVBM_Q7SVK7_3mutA_WS |
| EAAAK | 13,347 | BAEVM_P10272_3mutA |
| EAAAKGGGSS | 13,348 | BAEVM_P10272_3mutA |
| GGG | | WMSV_P03359_3mut |
| GGSGSSPAP | 13,350 | BAEVM_P10272_3mut |
| GGSEAAAKPAP | 13,351 | MLVBM_Q7SVK7_3mutA_WS |
| EAAAKGGSGSS | 13,352 | MLVCB_P08361_3mut |
| PAPGSS | 13,353 | MLVAV_P03356_3mutA |
| PAPEAAAKGGG | 13,354 | MLVCB_P08361_3mutA |
| AEAAAKEAAAKEAAAKEAAAKALEAEAAAKEAAAKEAAAKEAAAKA | 13,355 | FOAMV_P14350-Pro_2mut |
| GSSGSSGSS | 13,356 | PERV_Q4VFZ2_3mut |
| PAPGGG | 13,357 | MLVMS_P03355_3mut |
| PAPGGS | 13,358 | PERV_Q4VFZ2_3mut |
| GSSGGG | 13,359 | MLVMS_P03355_PLV919 |
| GSSGSSGSSGSSGSSGSS | 13,360 | WMSV_P03359_3mut |
| PAP | | AVIRE_P03360_3mutA |
| EAAAKGSSPAP | 13,362 | MLVBM_Q7SVK7_3mutA_WS |
| GSSGSSGSSGSS | 13,363 | MLVMS_P03355_PLV919 |
| GGGGSGGGGSGGGGSGGGGSGGGGS | 13,364 | AVIRE_P03360 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGS | 13,365 | PERV_Q4VFZ2_3mut |
| EAAAKGSSGGG | 13,366 | MLVBM_Q7SVK7_3mutA_WS |
| GGGGGG | 13,367 | KORV_Q9TTC1-Pro_3mut |
| GGSGSSEAAAK | 13,368 | PERV_Q4VFZ2_3mut |
| GSSPAPEAAAK | 13,369 | MLVBM_Q7SVK7_3mutA_WS |
| GGGGSGGGGS | 13,370 | MLVBM_Q7SVK7_3mutA_WS |
| GSSGGGGS | 13,371 | MLVAV_P03356_3mutA |
| GSAGSAAGSGEF | 13,372 | WMSV_P03359_3mutA |
| GGGEAAAKGSS | 13,373 | BAEVM_P10272_3mutA |
| AEAAAKEAAAKEAAAKEAAAKALEAEAAAKEAAAKEAAAKEAAAKA | 13,374 | FFV_093209-Pro_2mut |
| PAPGGSGGG | 13,375 | MLVCB_P08361_3mutA |
| EAAAKEAAAKEAAAKEAAAK | 13,376 | SFV3L_P27401_2mut |
| GGSGSSPAP | 13,377 | MLVMS_P03355_PLV919 |
| GGGGGG | 13,378 | PERV_Q4VFZ2_3mut |
| EAAAKEAAAKEAAAKEAAAKEAAAK | 13,379 | PERV_Q4VFZ2_3mut |
| EAAAKGSSPAP | 13,380 | MLVFF_P26809_3mut |
| GGGPAPGGS | 13,381 | MLVBM_Q7SVK7_3mutA_WS |
| AEAAAKEAAAKEAAAKEAAAKALEAEAAAKEAAAKEAAAKEAAAKA | 13,382 | SFV3L_P27401 |
| PAP | | PERV_Q4VFZ2_3mut |
| EAAAKGGS | 13,384 | MLVMS_P03355_PLV919 |
| GSSGGSEAAAK | 13,385 | WMSV_P03359_3mutA |
| GGSGSSEAAAK | 13,386 | KORV_Q9TTC1-Pro_3mutA |
| EAAAKEAAAKEAAAK | 13,387 | PERV_Q4VFZ2 |
| GGSGGGEAAAK | 13,388 | MLVMS_P03355_3mutA_WS |
| GGGGSGGGGSGGGGSGGGGS | 13,389 | BAEVM_P10272_3mut |
| EAAAKGSS | 13,390 | XMRV6_A1Z651_3mutA |
| GSSGGGGS | 13,391 | WMSV_P03359_3mutA |
| GSSGSSGSSGSSGSSGSS | 13,392 | MLVFF_P26809_3mutA |
| GGSGSS | 13,393 | MLVAV_P03356_3mutA |
| EAAAKGGGSEAAAK | 13,394 | MLVMS_P03355_PLV919 |
| EAAAKGGGPAP | 13,395 | PERV_Q4VFZ2 |
| GGSEAAAKGGG | 13,396 | MLVAV_P03356_3mutA |
| EAAAKEAAAKEAAAKEAAAKEAAAK | 13,397 | MLVBM_Q7SVK7_3mut |
| EAAAKEAAAKEAAAKEAAAKEAAAKEAAAK | 13,398 | KORV_Q9TTC1-Pro_3mutA |
| GSSPAPEAAAK | 13,399 | MLVFF_P26809_3mutA |
| GGGGSEAAAKGGGGS | 13,400 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GSSGSSGSSGSS | 13,401 | PERV_Q4VFZ2_3mut |
| GGSEAAAK | 13,402 | MLVFF_P26809_3mutA |
| GGGGGGGG | 13,403 | MLVMS_P03355_3mut |
| GSSGGG | 13,404 | XMRV6_A1Z651_3mutA |
| EAAAKGGS | 13,405 | BAEVM_P10272_3mutA |
| GGGGS | 13,406 | BAEVM_P10272_3mutA |
| GGSEAAAKGGG | 13,407 | KORV_Q9TTC1-Pro_3mutA |
| GGSGSSGGG | 13,408 | KORV_Q9TTC1_3mutA |
| GGSGSSEAAAK | 13,409 | WMSV_P03359_3mut |
| EAAAKGGSGSS | 13,410 | MLVBM_Q7SVK7_3mutA_WS |
| GGS | | BAEVM_P10272_3mutA |
| GGGPAPGSS | 13,412 | WMSV_P03359_3mutA |
| GSSGSSGSSGSSGSS | 13,413 | AVIRE_P03360_3mut |
| GGGEAAAKPAP | 13,414 | XMRV6_A1Z651_3mut |
| GSSGGG | 13,415 | MLVFF_P26809_3mut |
| GGSPAPGSS | 13,416 | PERV_Q4VFZ2_3mut |
| PAPGGS | 13,417 | MLVCB_P08361_3mut |
| PAPAPAPAPAP | 13,418 | KORV_Q9TTC1_3mutA |
| GSSGGS | 13,419 | MLVCB_P08361_3mut |
| GSSGGSEAAAK | 13,420 | PERV_Q4VFZ2_3mut |
| EAAAKGSSGGS | 13,421 | MLVMS_P03355_PLV919 |
| EAAAKGGG | 13,422 | WMSV_P03359_3mut |
| PAPGGGGGS | 13,423 | BAEVM_P10272_3mutA |
| GGGGSEAAAKGGGGS | 13,424 | WMSV_P03359_3mutA |
| EAAAKEAAAKEAAAKEAAAKEAAAK | 13,425 | MLVMS_P03355_3mutA_WS |
| GGS | | KORV_Q9TTC1-Pro_3mutA |
| GSSGGSPAP | 13,427 | BAEVM_P10272_3mutA |
| GGG | | MLVMS_P03355_PLV919 |
| PAPGSS | 13,429 | KORV_Q9TTC1-Pro_3mut |
| GGSEAAAKGGG | 13,430 | FLV_P10273_3mutA |
| GGSEAAAKPAP | 13,431 | PERV_Q4VFZ2_3mutA_WS |
| GGGGSSPAP | 13,432 | XMRV6_A1Z651_3mutA |
| EAAAKEAAAKEAAAKEAAAKEAAAK | 13,433 | PERV_Q4VFZ2_3mutA_WS |
| GGGG | 13,434 | PERV_Q4VFZ2_3mutA_WS |
| GGSEAAAKPAP | 13,435 | MLVMS_P03355_3mut |
| PAPGSSGGG | 13,436 | MLVMS_P03355_3mutA_WS |
| PAPEAAAKGGS | 13,437 | AVIRE_P03360_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGSSPAP | 13,438 | MLVMS_P03355_3mutA_WS |
| GGGGSGGGGSGGGGSGGGGS | 13,439 | PERV_Q4VFZ2_3mut |
| GGGEAAAK | 13,440 | MLVMS_P03355_3mut |
| GGGGSS | 13,441 | MLVFF_P26809_3mut |
| GGSPAPGSS | 13,442 | XMRV6_A1Z651_3mut |
| GGGGS | 13,443 | KORV_Q9TTC1-Pro_3mutA |
| EAAAKGSSGGS | 13,444 | FLV_P10273_3mutA |
| GSS | | MLVMS_P03355_PLV919 |
| GGGG | 13,446 | MLVMS_P03355_PLV919 |
| GSSGGS | 13,447 | MLVMS_P03355_PLV919 |
| GGSGGSGGSGGS | 13,448 | MLVMS_P03355_3mut |
| PAPEAAAKGGS | 13,449 | MLVMS_P03355_3mut |
| EAAAKGSSGGG | 13,450 | BAEVM_P10272_3mutA |
| GSSEAAAK | 13,451 | KORV_Q9TTC1-Pro_3mutA |
| GSAGSAAGSGEF | 13,452 | KORV_Q9TTC1_3mutA |
| GGGGGSEAAAK | 13,453 | MLVCB_P08361_3mut |
| GGGG | 13,454 | WMSV_P03359_3mut |
| GGGGSSEAAAK | 13,455 | MLVMS_P03355_PLV919 |
| PAPGGG | 13,456 | WMSV_P03359_3mutA |
| EAAAKGGSGGG | 13,457 | MLVAV_P03356_3mutA |
| GGGPAPGGS | 13,458 | MLVMS_P03355_3mut |
| EAAAKPAP | 13,459 | PERV_Q4VFZ2_3mutA_WS |
| GSSGSSGSS | 13,460 | KORV_Q9TTC1-Pro_3mutA |
| GSSPAPGGS | 13,461 | XMRV6_A1Z651_3mut |
| GGGGGSPAP | 13,462 | BAEVM_P10272_3mutA |
| GGSGSSGGG | 13,463 | PERV_Q4VFZ2_3mutA_WS |
| GGGEAAAKGSS | 13,464 | AVIRE_P03360_3mut |
| GSSEAAAK | 13,465 | FLV_P10273_3mutA |
| EAAAK | 13,466 | MLVMS_P03355_3mut |
| EAAAKGGSGSS | 13,467 | WMSV_P03359_3mut |
| GSSEAAAKGGG | 13,468 | PERV_Q4VFZ2_3mut |
| PAPGSSGGG | 13,469 | BAEVM_P10272_3mutA |
| EAAAKGGGGS | 13,470 | MLVMS_P03355_3mut |
| GGSEAAAKPAP | 13,471 | AVIRE_P03360_3mut |
| GGGPAPGGS | 13,472 | XMRV6_A1Z651_3mut |
| GGGGS | 13,473 | KORV_Q9TTC1_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSGGSGGSGGSGGS | 13,474 | XMRV6_A1Z651_3mut |
| GGGPAP | 13,475 | KORV_Q9TTC1-Pro_3mut |
| EAAAKPAP | 13,476 | MLVBM_Q7SVK7_3mutA_WS |
| GGSEAAAK | 13,477 | MLVMS_P03355_PLV919 |
| GSSEAAAKPAP | 13,478 | KORV_Q9TTC1-Pro_3mutA |
| GGSGSS | 13,479 | MLVMS_P03355_3mut |
| EAAAKPAPGGG | 13,480 | PERV_Q4VFZ2_3mut |
| GGSPAPEAAAK | 13,481 | KORV_Q9TTC1_3mutA |
| GGSEAAAKGGG | 13,482 | AVIRE_P03360_3mutA |
| GGGGSEAAAKGGGGS | 13,483 | MLVMS_P03355_PLV919 |
| GSSGGGEAAAK | 13,484 | KORV_Q9TTC1-Pro_3mutA |
| EAAAKGGGPAP | 13,485 | WMSV_P03359_3mut |
| GSSPAP | 13,486 | XMRV6_A1Z651_3mutA |
| AEAAAKEAAAKEAAAKEAAAKALEAEAAAKEAAAKEAAAKEAAAKA | 13,487 | SFV3L_P27401-Pro |
| GGSEAAAKGSS | 13,488 | MLVMS_P03355_PLV919 |
| GSSGGSEAAAK | 13,489 | KORV_Q9TTC1-Pro_3mutA |
| GGSEAAAKGSS | 13,490 | KORV_Q9TTC1-Pro_3mutA |
| EAAAKGGG | 13,491 | AVIRE_P03360_3mutA |
| GSSGGSEAAAK | 13,492 | BAEVM_P10272_3mutA |
| GGGGSEAAAKGGGGS | 13,493 | KORV_Q9TTC1-Pro_3mut |
| PAPGSSEAAAK | 13,494 | MLVMS_P03355_3mut |
| PAPEAAAK | 13,495 | WMSV_P03359_3mut |
| PAPGGSGSS | 13,496 | PERV_Q4VFZ2_3mutA_WS |
| PAPGSS | 13,497 | BAEVM_P10272_3mut |
| PAPGGGGGS | 13,498 | MLVMS_P03355_3mut |
| EAAAKPAPGSS | 13,499 | MLVBM_Q7SVK7_3mutA_WS |
| GSSPAPGGS | 13,500 | MLVMS_P03355_PLV919 |
| GGSGSSEAAAK | 13,501 | MLVMS_P03355_3mut |
| GGGGGG | 13,502 | KORV_Q9TTC1-Pro_3mutA |
| EAAAKEAAAKEAAAKEAAAK | 13,503 | MLVBM_Q7SVK7_3mut |
| GGSPAPGSS | 13,504 | MLVMS_P03355_PLV919 |
| PAPAPAPAPAP | 13,505 | MLVCB_P08361_3mut |
| GGSGSSPAP | 13,506 | WMSV_P03359_3mutA |
| EAAAKGGSGGG | 13,507 | PERV_Q4VFZ2_3mutA_WS |
| GSSGSSGSSGSSGSS | 13,508 | PERV_Q4VFZ2_3mut |
| AEAAAKEAAAKEAAAKEAAAKALEAEAAAKEAAAKEAAAKEAAAKA | 13,509 | KORV_Q9TTC1_3mutA |
| GSSGGGEAAAK | 13,510 | WMSV_P03359_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGSEAAAK | 13,511 | FLV_P10273_3mutA |
| GGGGGGGG | 13,512 | PERV_Q4VFZ2_3mut |
| PAPGGSEAAAK | 13,513 | FLV_P10273_3mutA |
| GGGGSSPAP | 13,514 | BAEVM_P10272_3mutA |
| PAPAPAPAP | 13,515 | WMSV_P03359_3mut |
| GGSEAAAKPAP | 13,516 | PERV_Q4VFZ2_3mut |
| PAPGGSGGG | 13,517 | BAEVM_P10272_3mutA |
| EAAAKEAAAKEAAAKEAAAKEAAAK | 13,518 | MLVMS_P03355_3mut |
| GGGGSGGGGSGGGGS | 13,519 | PERV_Q4VFZ2_3mut |
| GGSGGGPAP | 13,520 | PERV_Q4VFZ2_3mut |
| GGGPAPEAAAK | 13,521 | MLVFF_P26809_3mut |
| GGGGGSGSS | 13,522 | MLVMS_P03355_3mutA_WS |
| GSS | | MLVCB_P08361_3mut |
| GGGGGSPAP | 13,524 | MLVMS_P03355_PLV919 |
| GGSPAP | 13,525 | MLVAV_P03356_3mutA |
| GGGPAPGGS | 13,526 | KORV_Q9TTC1-Pro_3mutA |
| PAPGSSGGG | 13,527 | FLV_P10273_3mutA |
| PAPGSSGGG | 13,528 | WMSV_P03359_3mutA |
| PAPGGS | 13,529 | MLVBM_Q7SVK7_3mutA_WS |
| GGGEAAAKGSS | 13,530 | PERV_Q4VFZ2_3mutA_WS |
| GGSEAAAKGSS | 13,531 | MLVBM_Q7SVK7_3mutA_WS |
| PAPGGSEAAAK | 13,532 | MLVCB_P08361_3mut |
| GGSEAAAKGGG | 13,533 | XMRV6_A1Z651_3mutA |
| GGSGGGGSS | 13,534 | WMSV_P03359_3mut |
| GGGEAAAKPAP | 13,535 | KORV_Q9TTC1_3mutA |
| EAAAKGSS | 13,536 | KORV_Q9TTC1-Pro_3mut |
| PAPEAAAKGSS | 13,537 | MLVFF_P26809_3mut |
| GSAGSAAGSGEF | 13,538 | PERV_Q4VFZ2_3mut |
| EAAAKGGGGS | 13,539 | WMSV_P03359_3mut |
| EAAAKGSSPAP | 13,540 | WMSV_P03359_3mutA |
| GGGGSEAAAKGGGGS | 13,541 | XMRV6_A1Z651_3mutA |
| GSSEAAAKPAP | 13,542 | SFV3L_P27401-Pro_2mutA |
| GGGGGG | 13,543 | PERV_Q4VFZ2_3mutA_WS |
| PAPGGS | 13,544 | BAEVM_P10272_3mut |
| PAP | | AVIRE_P03360_3mut |
| PAPAPAP | 13,546 | MLVBM_Q7SVK7_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGG | 13,547 | PERV_Q4VFZ2_3mutA_WS |
| GSSGGSEAAAK | 13,548 | MLVBM_Q7SVK7_3mut |
| GGSGGGGSS | 13,549 | MLVFF_P26809_3mut |
| GGGGSSGGS | 13,550 | AVIRE_P03360_3mutA |
| GSSPAPGGG | 13,551 | PERV_Q4VFZ2_3mutA_WS |
| GGSEAAAKPAP | 13,552 | MLVMS_P03355_PLV919 |
| PAP | | KORV_Q9TTC1-Pro_3mut |
| GSSGGS | 13,554 | PERV_Q4VFZ2_3mut |
| GGGGG | 13,555 | PERV_Q4VFZ2_3mut |
| GSSGGGPAP | 13,556 | FLV_P10273_3mutA |
| GSSEAAAKGGG | 13,557 | KORV_Q9TTC1-Pro_3mut |
| EAAAKEAAAKEAAAKEAAAKEAAAK | 13,558 | MLVCB_P08361_3mut |
| GGSEAAAKPAP | 13,559 | MLVCB_P08361_3mut |
| PAPAPAPAPAPAP | 13,560 | BAEVM_P10272_3mutA |
| GGGGSEAAAKGGGGS | 13,561 | MLVMS_P03355_3mut |
| EAAAKPAPGSS | 13,562 | MLVMS_P03355_3mut |
| GSSGSSGSSGSSGSS | 13,563 | MLVBM_Q7SVK7_3mutA_WS |
| PAPEAAAKGSS | 13,564 | MLVAV_P03356_3mut |
| AEAAAKEAAAKEAAAKEAAAKALEAEAAAKEAAAKEAAAKEAAAKA | 13,565 | AVIRE_P03360_3mut |
| AEAAAKEAAAKEAAAKEAAAKALEAEAAAKEAAAKEAAAKEAAAKA | 13,566 | PERV_Q4VFZ2_3mut |
| GGSEAAAKGGG | 13,567 | PERV_Q4VFZ2_3mutA_WS |
| GGSGGGGSS | 13,568 | MLVFF_P26809_3mutA |
| PAPEAAAKGSS | 13,569 | MLVCB_P08361_3mut |
| GGG | | PERV_Q4VFZ2_3mutA_WS |
| GGSGGGEAAAK | 13,571 | MLVMS_P03355_3mut |
| EAAAKGGGGSS | 13,572 | WMSV_P03359_3mut |
| GSSPAPGGG | 13,573 | WMSV_P03359_3mutA |
| EAAAKGSSGGG | 13,574 | PERV_Q4VFZ2_3mut |
| GGSGGGEAAAK | 13,575 | PERV_Q4VFZ2_3mutA_WS |
| GGSGGSGGSGGSGGS | 13,576 | PERV_Q4VFZ2_3mutA_WS |
| EAAAKPAPGGS | 13,577 | PERV_Q4VFZ2_3mutA_WS |
| GGGGGSEAAAK | 13,578 | PERV_Q4VFZ2_3mutA_WS |
| GSSPAP | 13,579 | MLVFF_P26809_3mut |
| GGGEAAAKPAP | 13,580 | AVIRE_P03360_3mut |
| GSSGGSEAAAK | 13,581 | MLVMS_P03355_PLV919 |
| EAAAKPAPGGS | 13,582 | WMSV_P03359_3mutA |
| PAPGGG | 13,583 | KORV_Q9TTC1_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKGSSPAP | 13,584 | KORV_Q9TTC1-Pro_3mut |
| GSSPAPEAAAK | 13,585 | MLVFF_P26809_3mut |
| GGSGGGEAAAK | 13,586 | MLVFF_P26809_3mutA |
| GSSGSSGSS | 13,587 | WMSV_P03359_3mutA |
| EAAAKGGS | 13,588 | BAEVM_P10272_3mut |
| EAAAKPAPGGS | 13,589 | KORV_Q9TTC1_3mutA |
| EAAAKPAPGGS | 13,590 | BAEVM_P10272_3mutA |
| GSSGGGGS | 13,591 | PERV_Q4VFZ2_3mut |
| PAPGGGGSS | 13,592 | PERV_Q4VFZ2_3mut |
| GSSGSSGSS | 13,593 | WMSV_P03359_3mut |
| EAAAKEAAAKEAAAKEAAAK | 13,594 | WMSV_P03359_3mut |
| GGS | | AVIRE_P03360_3mut |
| EAAAKPAPGSS | 13,596 | MLVFF_P26809_3mut |
| EAAAKGGG | 13,597 | KORV_Q9TTC1_3mut |
| PAPGSSEAAAK | 13,598 | MLVMS_P03355_3mut |
| PAPGSSGGS | 13,599 | MLVMS_P03355_PLV919 |
| GSSPAPEAAAK | 13,600 | MLVMS_P03355_3mut |
| GSSGSSGSSGSSGSSGSS | 13,601 | WMSV_P03359_3mutA |
| GGGGS | 13,602 | BAEVM_P10272_3mut |
| GSSPAP | 13,603 | MLVMS_P03355_3mut |
| EAAAKGGGGSEAAAK | 13,604 | KORV_Q9TTC1-Pro_3mutA |
| EAAAKEAAAK | 13,605 | WMSV_P03359_3mutA |
| GGGGSSGGS | 13,606 | MLVCB_P08361_3mutA |
| PAPGGSEAAAK | 13,607 | BAEVM_P10272_3mut |
| EAAAKGGSPAP | 13,608 | MLVFF_P26809_3mut |
| GSSGGSGGG | 13,609 | MLVBM_Q7SVK7_3mutA_WS |
| GSSGGS | 13,610 | PERV_Q4VFZ2_3mut |
| PAPGGSGSS | 13,611 | PERV_Q4VFZ2_3mutA_WS |
| EAAAKGGSGSS | 13,612 | KORV_Q9TTC1-Pro_3mutA |
| PAPAP | 13,613 | MLVCB_P08361_3mut |
| EAAAKGSSPAP | 13,614 | PERV_Q4VFZ2_3mutA_WS |
| EAAAKPAPGGG | 13,615 | MLVMS_P03355_PLV919 |
| GGGGSGGGGGGGSGGGGSGGGGSGGGGS | 13,616 | MLVBM_Q7SVK7_3mut |
| EAAAKGGGGSS | 13,617 | MLVMS_P03355_PLV919 |
| PAPEAAAK | 13,618 | PERV_Q4VFZ2_3mut |
| EAAAKPAPGSS | 13,619 | BAEVM_P10272_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSPAP | 13,620 | PERV_Q4VFZ2_3mutA_WS |
| GGSGGS | 13,621 | BAEVM_P10272_3mutA |
| PAPEAAAKGSS | 13,622 | KORV_Q9TTC1_3mut |
| PAPGSS | 13,623 | MLVMS_P03355_PLV919 |
| PAPAPAPAPAP | 13,624 | MLVAV_P03356_3mutA |
| GGG | | XMRV6_A1Z651_3mutA |
| GGGPAP | 13,626 | PERV_Q4VFZ2_3mutA_WS |
| GSSPAPEAAAK | 13,627 | KORV_Q9TTC1_3mutA |
| PAP | | BAEVM_P10272_3mutA |
| GGSPAP | 13,629 | BAEVM_P10272_3mutA |
| PAPEAAAKGGS | 13,630 | MLVMS_P03355_PLV919 |
| PAPGSSGGS | 13,631 | PERV_Q4VFZ2_3mutA_WS |
| PAPAPAPAPAPAP | 13,632 | PERV_Q4VFZ2_3mut |
| EAAAKEAAAKEAAAK | 13,633 | MLVCB_P08361_3mut |
| GGSGGSGGSGGSGGS | 13,634 | MLVMS_P03355_PLV919 |
| EAAAKPAPGGS | 13,635 | MLVMS_P03355_3mut |
| GGSGGS | 13,636 | MLVMS_P03355_PLV919 |
| EAAAKPAP | 13,637 | MLVMS_P03355_3mutA_WS |
| GGSEAAAK | 13,638 | XMRV6_A1Z651_3mutA |
| GGSGGG | 13,639 | KORV_Q9TTC1_3mut |
| GGSGGGEAAAK | 13,640 | PERV_Q4VFZ2_3mut |
| PAPEAAAKGGG | 13,641 | AVIRE_P03360 |
| PAPAP | 13,642 | PERV_Q4VFZ2_3mut |
| GSS | | KORV_Q9TTC1-Pro_3mutA |
| EAAAKGSSGGG | 13,644 | MLVAV_P03356_3mutA |
| GGSPAPGSS | 13,645 | MLVBM_Q7SVK7_3mutA_WS |
| PAPEAAAK | 13,646 | MLVAV_P03356_3mut |
| EAAAKGGSPAP | 13,647 | BAEVM_P10272_3mutA |
| PAPAPAPAP | 13,648 | WMSV_P03359_3mutA |
| PAPGGSEAAAK | 13,649 | MLVMS_P03355_3mut |
| GGSGGSGGSGGS | 13,650 | WMSV_P03359_3mut |
| GGGGGSGSS | 13,651 | XMRV6_A1Z651_3mut |
| PAPGGSGGG | 13,652 | KORV_Q9TTC1_3mutA |
| GGS | | MLVMS_P03355_3mut |
| EAAAK | 13,654 | WMSV_P03359_3mut |
| GGGEAAAKGSS | 13,655 | MLVBM_Q7SVK7_3mutA_WS |
| GGSPAPGSS | 13,656 | MLVCB_P08361_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSEAAAKPAP | 13,657 | PERV_Q4VFZ2_3mut |
| GGGGSGGGGSGGGGSGGGGSGGGGS | 13,658 | MLVCB_P08361_3mutA |
| GGSGSS | 13,659 | BAEVM_P10272_3mutA |
| GGGEAAAKGSS | 13,660 | WMSV_P03359_3mutA |
| EAAAKGGSPAP | 13,661 | WMSV_P03359_3mut |
| GSSPAPEAAAK | 13,662 | MLVMS_P03355_3mut |
| GGSGGSGGSGGS | 13,663 | MLVMS_P03355_PLV919 |
| GSSPAPEAAAK | 13,664 | WMSV_P03359_3mut |
| GSSGSSGSSGSS | 13,665 | PERV_Q4VFZ2 |
| GGSGSSEAAAK | 13,666 | WMSV_P03359_3mutA |
| GGSGGG | 13,667 | MLVFF_P26809_3mut |
| GGSPAPGGG | 13,668 | MLVFF_P26809_3mut |
| GGSGGSGGS | 13,669 | BAEVM_P10272_3mutA |
| GGGGSSEAAAK | 13,670 | MLVBM_Q7SVK7_3mut |
| GGSPAPGSS | 13,671 | MLVMS_P03355_3mut |
| EAAAKPAPGSS | 13,672 | AVIRE_P03360_3mut |
| GGGGSSGGS | 13,673 | FLV_P10273_3mutA |
| GGSPAPEAAAK | 13,674 | PERV_Q4VFZ2_3mut |
| GGSEAAAK | 13,675 | MLVMS_P03355_3mutA_WS |
| GSSGSSGSSGSS | 13,676 | MLVCB_P08361_3mutA |
| EAAAKEAAAKEAAAKEAAAKEAAAK | 13,677 | MLVMS_P03355_PLV919 |
| GGGGG | 13,678 | PERV_Q4VFZ2_3mut |
| GGSEAAAKGSS | 13,679 | MLVCB_P08361_3mutA |
| GSSGGG | 13,680 | MLVBM_Q7SVK7_3mutA_WS |
| PAPGSSGGG | 13,681 | KORV_Q9TTC1-Pro_3mutA |
| GGSGGS | 13,682 | BAEVM_P10272_3mut |
| EAAAKGGGGS | 13,683 | MLVBM_Q7SVK7_3mutA_WS |
| GGSGSSPAP | 13,684 | MLVCB_P08361_3mut |
| PAPGSSGGG | 13,685 | KORV_Q9TTC1 |
| PAPGGSGGG | 13,686 | MLVMS_P03355_3mut |
| GGGG | 13,687 | WMSV_P03359_3mutA |
| EAAAKGGSPAP | 13,688 | MLVCB_P08361_3mut |
| GSSGSS | 13,689 | FLV_P10273_3mutA |
| GGSEAAAKPAP | 13,690 | SFV3L_P27401_2mut |
| EAAAKGSSGGS | 13,691 | MLVAV_P03356_3mutA |
| AEAAAKEAAAKEAAAKEAAAKALEAEAAAKEAAAKEAAAKEAAAKA | 13,692 | MLVAV_P03356_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGGSGSS | 13,693 | PERV_Q4VFZ2_3mutA_WS |
| GGGGG | 13,694 | MLVCB_P08361_3mut |
| GGGEAAAK | 13,695 | BAEVM_P10272_3mut |
| GGSGGSGGSGGS | 13,696 | MLVCB_P08361_3mut |
| EAAAKEAAAKEAAAKEAAAKEAAAK | 13,697 | PERV_Q4VFZ2 |
| PAPAPAPAPAP | 13,698 | MLVMS_P03355_3mutA_WS |
| EAAAKEAAAK | 13,699 | XMRV6_A1Z651_3mut |
| GSSGGSEAAAK | 13,700 | PERV_Q4VFZ2_3mutA_WS |
| PAPGGSEAAAK | 13,701 | KORV_Q9TTC1-Pro_3mutA |
| EAAAKGGGPAP | 13,702 | MLVBM_Q7SVK7_3mutA_WS |
| PAPGGSGSS | 13,703 | PERV_Q4VFZ2 |
| SGSETPGTSESATPES | 13,704 | MLVMS_P03355_3mut |
| GGSGGS | 13,705 | MLVMS_P03355_PLV919 |
| EAAAKGGS | 13,706 | FLV_P10273_3mut |
| GGSPAPGSS | 13,707 | MLVMS_P03355_3mutA_WS |
| EAAAKEAAAKEAAAKEAAAK | 13,708 | FFV_093209_2mut |
| GSSGGSGGG | 13,709 | MLVMS_P03355_3mutA_WS |
| PAPGSSEAAAK | 13,710 | WMSV_P03359_3mut |
| PAPAPAPAPAPAP | 13,711 | KORV_Q9TTC1_3mutA |
| GGGGSS | 13,712 | BAEVM_P10272_3mut |
| GGGGSEAAAKGGGGS | 13,713 | AVIRE_P03360_3mut |
| GSSPAPEAAAK | 13,714 | KORV_Q9TTC1-Pro_3mutA |
| PAPEAAAKGGG | 13,715 | MLVBM_Q7SVK7_3mut |
| EAAAKEAAAK | 13,716 | WMSV_P03359_3mut |
| EAAAK | 13,717 | SFV3L_P27401-Pro_2mutA |
| GSSGGSGGG | 13,718 | XMRV6_A1Z651_3mutA |
| GGGEAAAKPAP | 13,719 | WMSV_P03359_3mutA |
| GGSGGS | 13,720 | MLVFF_P26809_3mutA |
| EAAAKEAAAKEAAAKEAAAKEAAAK | 13,721 | FOAMV_P14350_2mutA |
| GGGGG | 13,722 | MLVAV_P03356_3mutA |
| GSSGGSEAAAK | 13,723 | BAEVM_P10272_3mut |
| SGGSSGGSSGSETPGTSESATPESSGGSSGGSS | 13,724 | SFV1_P23074 |
| GGSGGGPAP | 13,725 | MLVCB_P08361_3mut |
| GGSGSS | 13,726 | PERV_Q4VFZ2_3mut |
| SGSETPGTSESATPES | 13,727 | MLVFF_P26809_3mut |
| EAAAKGGSPAP | 13,728 | MLVMS_P03355_3mut |
| PAPAP | 13,729 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| AEAAAKEAAAKEAAAKEAAAKALEAEAAAKEAAAKEAAAKEAAAKA | 13,730 | MLVBM_Q7SVK7_3mut |
| GGGGGS | 13,731 | BAEVM_P10272_3mutA |
| EAAAKEAAAK | 13,732 | AVIRE_P03360_3mut |
| GSSGGSEAAAK | 13,733 | PERV_Q4VFZ2_3mut |
| GGGEAAAK | 13,734 | WMSV_P03359_3mut |
| GSSGGGEAAAK | 13,735 | AVIRE_P03360_3mutA |
| GGG | | XMRV6_A1Z651_3mut |
| GGGGSEAAAKGGGGS | 13,737 | BAEVM_P10272_3mut |
| GGGG | 13,738 | MLVMS_P03355_3mut |
| GGSGGS | 13,739 | MLVMS_P03355_3mutA_WS |
| GGSGGGGSS | 13,740 | MLVBM_Q7SVK7_3mutA_WS |
| GSSPAPGGS | 13,741 | PERV_Q4VFZ2_3mut |
| GSSPAPEAAAK | 13,742 | PERV_Q4VFZ2_3mutA_WS |
| EAAAKGGS | 13,743 | WMSV_P03359_3mut |
| GGSGGSGGSGGS | 13,744 | PERV_Q4VFZ2_3mut |
| GGGGSSEAAAK | 13,745 | KORV_Q9TTC1-Pro_3mut |
| PAPAPAPAPAPAP | 13,746 | MLVAV_P03356_3mut |
| EAAAKGSSGGG | 13,747 | MLVMS_P03355_PLV919 |
| GGGGG | 13,748 | MLVBM_Q7SVK7_3mutA_WS |
| AEAAAKEAAAKEAAAKEAAAKALEAEAAAKEAAAKEAAAKEAAAKA | 13,749 | FFV_093209_2mutA |
| SGGSSGGSSGGSETPGTSESATPESSGGSSGGSS | 13,750 | KORV_Q9TTC1-Pro_3mut |
| GGSPAPGGG | 13,751 | MLVMS_P03355_3mutA_WS |
| GGGEAAAKGGS | 13,752 | MLVMS_P03355_3mut |
| GGGEAAAK | 13,753 | PERV_Q4VFZ2_3mut |
| PAPEAAAKGGG | 13,754 | MLVMS_P03355_3mut |
| GSSGSSGSSGSSGSSGSS | 13,755 | BAEVM_P10272_3mutA |
| AEAAAKEAAAKEAAAKEAAAKALEAEAAAKEAAAKEAAAKEAAAKA | 13,756 | GALV_P21414_3mutA |
| EAAAKGGSPAP | 13,757 | FFV_093209-Pro |
| EAAAKEAAAK | 13,758 | MLVFF_P26809_3mut |
| GGGGSGGGGSGGGGSGGGGSGGGGSGGGGS | 13,759 | PERV_Q4VFZ2_3mutA_WS |
| GGSGGSGGSGGS | 13,760 | MLVAV_P03356_3mutA |
| EAAAKEAAAKEAAAKEAAAKEAAAK | 13,761 | SFV3L_P27401_2mutA |
| GSSGSSGSSGSSGSSGSS | 13,762 | BAEVM_P10272_3mut |
| GGGGS | 13,763 | MLVMS_P03355_PLV919 |
| AEAAAKEAAAKEAAAKEAAAKALEAEAAAKEAAAKEAAAKEAAAKA | 13,764 | SFV1_P23074 |
| GGGGSGGGGS | 13,765 | KORV_Q9TTC1-Pro_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSGGGGS | 13,766 | MLVMS_P03355_3mut |
| GGSGSS | 13,767 | KORV_Q9TTC1_3mutA |
| GSSPAPGGG | 13,768 | PERV_Q4VFZ2_3mut |
| GSSGGSPAP | 13,769 | PERV_Q4VFZ2_3mutA_WS |
| PAPGGS | 13,770 | PERV_Q4VFZ2_3mutA_WS |
| GGSPAPEAAAK | 13,771 | FOAMV_P14350_2mutA |
| GGGPAPGGS | 13,772 | SFV3L_P27401_2mut |
| PAPGSSGGG | 13,773 | MLVCB_P08361_3mut |
| GSSGGGEAAAK | 13,774 | AVIRE_P03360_3mut |
| GSSGGG | 13,775 | XMRV6_A1Z651_3mut |
| GSSGSS | 13,776 | PERV_Q4VFZ2_3mut |
| GSSGGG | 13,777 | MLVAV_P03356_3mutA |
| PAPGGGGGS | 13,778 | PERV_Q4VFZ2_3mut |
| GSSEAAAK | 13,779 | MLVMS_P03355_3mut |
| PAPGGG | 13,780 | FLV_P10273_3mutA |
| GGGGSGGGGS | 13,781 | PERV_Q4VFZ2_3mut |
| GSSGGS | 13,782 | MLVMS_P03355_PLV919 |
| GGGGSGGGGS | 13,783 | SFV3L_P27401_2mut |
| EAAAKGGSGSS | 13,784 | FLV_P10273_3mutA |
| GSSEAAAKGGS | 13,785 | MLVMS_P03355_3mutA_WS |
| PAPGSSEAAAK | 13,786 | SFV3L_P27401_2mutA |
| GGGGGGGGS | 13,787 | SFV3L_P27401-Pro_2mutA |
| PAPGSSEAAAK | 13,788 | PERV_Q4VFZ2_3mut |
| PAPGSSEAAAK | 13,789 | PERV_Q4VFZ2 |
| GGSPAPGGG | 13,790 | AVIRE_P03360_3mut |
| GGGGGS | 13,791 | PERV_Q4VFZ2_3mutA_WS |
| GGGGSSGGS | 13,792 | PERV_Q4VFZ2_3mut |
| PAPAPAPAP | 13,793 | AVIRE_P03360_3mutA |
| GGSGGS | 13,794 | WMSV_P03359_3mutA |
| GGGPAPGGS | 13,795 | PERV_Q4VFZ2_3mut |
| GGSGGSGGSGGSGGS | 13,796 | MLVMS_P03355_PLV919 |
| GGSGGG | 13,797 | PERV_Q4VFZ2_3mut |
| EAAAKEAAAK | 13,798 | SFV3L_P27401_2mut |
| PAPGSS | 13,799 | XMRV6_A1Z651_3mut |
| GSSEAAAK | 13,800 | MLVFF_P26809_3mut |
| GGSPAPGGG | 13,801 | MLVMS_P03355_3mut |
| EAAAKGGG | 13,802 | WMSV_P03359_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GSSEAAAKGGS | 13,803 | PERV_Q4VFZ2_3mutA_WS |
| GSSGGSPAP | 13,804 | FFV_093209 |
| GGGGGS | 13,805 | KORV_Q9TTC1-Pro_3mut |
| GSSGGG | 13,806 | MLVCB_P08361_3mut |
| GSSGSS | 13,807 | MLVCB_P08361_3mutA |
| GGSEAAAKPAP | 13,808 | BAEVM_P10272_3mut |
| EAAAKGGGGSS | 13,809 | MLVCB_P08361_3mut |
| EAAAKPAPGGS | 13,810 | KORV_Q9TTC1-Pro_3mutA |
| GSSGSSGSSGSSGSS | 13,811 | MLVAV_P03356_3mutA |
| GGGGSEAAAKGGGGS | 13,812 | PERV_Q4VFZ2_3mutA_WS |
| GGSGSS | 13,813 | KORV_Q9TTC1-Pro_3mut |
| GSS | | SFV3L_P27401-Pro_2mutA |
| PAPAP | 13,815 | BAEVM_P10272_3mut |
| EAAAKPAP | 13,816 | BAEVM_P10272 |
| EAAAKEAAAKEAAAKEAAAKEAAAK | 13,817 | KORV_Q9TTC1-Pro_3mut |
| GGGGGGG | 13,818 | PERV_Q4VFZ2_3mutA_WS |
| GGGGS | 13,819 | MLVMS_P03355_3mut |
| GSSGGG | 13,820 | FLV_P10273_3mutA |
| PAPAPAPAPAP | 13,821 | FLV_P10273_3mut |
| EAAAKEAAAKEAAAK | 13,822 | WMSV_P03359_3mutA |
| GSSGGS | 13,823 | MLVBM_Q7SVK7_3mutA_WS |
| EAAAKPAPGGG | 13,824 | MLVMS_P03355_3mut |
| GSSPAPGGS | 13,825 | WMSV_P03359_3mut |
| PAPGSSGGG | 13,826 | PERV_Q4VFZ2_3mutA_WS |
| GSSGGG | 13,827 | AVIRE_P03360_3mutA |
| PAPGGSGSS | 13,828 | MLVFF_P26809_3mut |
| PAPGSS | 13,829 | PERV_Q4VFZ2_3mut |
| GGGGGSGSS | 13,830 | WMSV_P03359_3mutA |
| EAAAKGGGGSS | 13,831 | MLVBM_Q7SVK7_3mutA_WS |
| GGGGGGG | 13,832 | BAEVM_P10272_3mut |
| PAPEAAAKGSS | 13,833 | MLVMS_P03355_3mut |
| GGSGGGEAAAK | 13,834 | MLVMS_P03355_PLV919 |
| EAAAKGGGGS | 13,835 | MLVCB_P08361_3mut |
| PAPGGS | 13,836 | KORV_Q9TTC1-Pro_3mut |
| GGGG | 13,837 | FLV_P10273_3mutA |
| EAAAKGGSGSS | 13,838 | MLVBM_Q7SVK7_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSSGGS | 13,839 | MLVMS_P03355_3mutA_WS |
| GGGGGGGG | 13,840 | WMSV_P03359_3mut |
| GGSGSSGGG | 13,841 | MLVMS_P03355_PLV919 |
| GSSEAAAKGGS | 13,842 | KORV_Q9TTC1-Pro_3mutA |
| EAAAKPAPGSS | 13,843 | MLVCB_P08361_3mut |
| GGSPAPGSS | 13,844 | KORV_Q9TTC1_3mutA |
| PAPGSSGGG | 13,845 | BAEVM_P10272_3mut |
| EAAAKPAPGSS | 13,846 | WMSV_P03359_3mut |
| GGSPAPEAAAK | 13,847 | XMRV6_A1Z651_3mutA |
| GSSPAP | 13,848 | FLV_P10273_3mutA |
| GSS | | BAEVM_P10272_3mutA |
| EAAAKPAPGGS | 13,850 | FLV_P10273_3mutA |
| GGSGSSPAP | 13,851 | FLV_P10273_3mutA |
| PAPGSSGGS | 13,852 | MLVMS_P03355_3mut |
| GSAGSAAGSGEF | 13,853 | PERV_Q4VFZ2_3mutA_WS |
| GSSGGSEAAAK | 13,854 | KORV_Q9TTC1_3mutA |
| GSSGGS | 13,855 | MLVMS_P03355_3mutA_WS |
| EAAAKGGGGSEAAAK | 13,856 | SFV3L_P27401_2mut |
| GSSGGS | 13,857 | PERV_Q4VFZ2_3mutA_WS |
| GGSPAPEAAAK | 13,858 | FLV_P10273_3mut |
| GGSEAAAKGSS | 13,859 | PERV_Q4VFZ2_3mutA_WS |
| GSSPAPEAAAK | 13,860 | PERV_Q4VFZ2_3mutA_WS |
| GGSGSSGGG | 13,861 | PERV_Q4VFZ2_3mut |
| GGGG | 13,862 | AVIRE_P03360_3mutA |
| GGSEAAAKPAP | 13,863 | WMSV_P03359_3mut |
| GSSGGSPAP | 13,864 | MLVAV_P03356_3mutA |
| GSSGGSEAAAK | 13,865 | MLVMS_P03355_3mut |
| PAPEAAAKGGS | 13,866 | KORV_Q9TTC1-Pro_3mut |
| GGSPAP | 13,867 | PERV_Q4VFZ2_3mutA_WS |
| GGSEAAAK | 13,868 | MLVAV_P03356_3mutA |
| EAAAKGGGGSEAAAK | 13,869 | KORV_Q9TTC1-Pro_3mut |
| SGGSSGGSSGSETPGTSESATPESSGGSSGGSS | 13,870 | MLVMS_P03355_PLV919 |
| GSSEAAAK | 13,871 | KORV_Q9TTC1_3mutA |
| GGG | | AVIRE_P03360 |
| GGSEAAAKGSS | 13,873 | MLVBM_Q7SVK7_3mut |
| GGSEAAAKGSS | 13,874 | MLVMS_P03355_3mut |
| GGSPAPEAAAK | 13,875 | MLVCB_P08361_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSGGGEAAAK | 13,876 | MLVCB_P08361_3mut |
| GGSEAAAKPAP | 13,877 | MLVMS_P03355_3mutA_WS |
| EAAAKGGSGSS | 13,878 | KORV_Q9TTC1-Pro_3mut |
| GGGEAAAKGGS | 13,879 | MLVCB_P08361_3mut |
| EAAAKGGGGSEAAAK | 13,880 | FLV_P10273_3mutA |
| GGSPAP | 13,881 | MLVFF_P26809_3mut |
| GGGGSSGGS | 13,882 | XMRV6_A1Z651_3mutA |
| PAP | | MLVCB_P08361_3mut |
| GGS | | SFV3L_P27401-Pro_2mutA |
| GGGGSGGGGS | 13,885 | MLVMS_P03355_3mut |
| GGGEAAAKGGS | 13,886 | MLVAV_P03356_3mutA |
| GSSGSSGSSGSSGSSGSS | 13,887 | MLVMS_P03355_PLV919 |
| PAPGSS | 13,888 | MLVCB_P08361_3mut |
| GGSGGSGGS | 13,889 | MLVMS_P03355_PLV919 |
| PAPGGSGGG | 13,890 | FLV_P10273_3mutA |
| GGGGSGGGGSGGGGS | 13,891 | FLV_P10273_3mut |
| GGSGSSGGG | 13,892 | KORV_Q9TTC1-Pro_3mutA |
| GGSGGSGGS | 13,893 | GALV_P21414_3mutA |
| GGGEAAAKGGS | 13,894 | WMSV_P03359_3mut |
| SGSETPGTSESATPES | 13,895 | KORV_Q9TTC1_3mutA |
| EAAAKGGGGS | 13,896 | KORV_Q9TTC1-Pro_3mut |
| EAAAKGSSPAP | 13,897 | BAEVM_P10272_3mut |
| GGGG | 13,898 | MLVCB_P08361_3mut |
| GGGGSGGGGSGGGGSGGGGSGGGGS | 13,899 | MLVBM_Q7SVK7_3mut |
| GSSGGSGGG | 13,900 | MLVMS_P03355_PLV919 |
| GGSGSS | 13,901 | MLVFF_P26809_3mut |
| EAAAKGGS | 13,902 | AVIRE_P03360_3mutA |
| GSSEAAAKGGS | 13,903 | MLVBM_Q7SVK7_3mutA_WS |
| EAAAKPAPGGG | 13,904 | WMSV_P03359_3mut |
| PAPGSSGGG | 13,905 | MLVCB_P08361_3mutA |
| GGGGSSEAAAK | 13,906 | KORV_Q9TTC1-Pro_3mutA |
| GSSEAAAKPAP | 13,907 | BAEVM_P10272_3mut |
| PAPGGGEAAAK | 13,908 | MLVBM_Q7SVK7_3mutA_WS |
| GGSGGGEAAAK | 13,909 | MLVCB_P08361_3mut |
| GGGGSGGGGSGGGGSGGGGSGGGGSGGGGS | 13,910 | FFV_093209 |
| EAAAKGGGGS | 13,911 | GALV_P21414_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSPAPGGG | 13,912 | MLVMS_P03355_3mut |
| GSSGSSGSS | 13,913 | FLV_P10273_3mutA |
| EAAAK | 13,914 | MLVBM_Q7SVK7_3mut |
| GGGGSSGGS | 13,915 | MLVMS_P03355_3mut |
| GGSGSSPAP | 13,916 | PERV_Q4VFZ2_3mut |
| EAAAKEAAAKEAAAKEAAAK | 13,917 | BAEVM_P10272_3mut |
| GGGPAPGSS | 13,918 | MLVMS_P03355_3mut |
| GSSPAPGGS | 13,919 | PERV_Q4VFZ2_3mutA_WS |
| PAPAP | 13,920 | FLV_P10273_3mutA |
| PAPAPAPAP | 13,921 | PERV_Q4VFZ2_3mut |
| GGGGGSEAAAK | 13,922 | GALV_P21414_3mutA |
| GGGGGSGSS | 13,923 | BAEVM_P10272_3mutA |
| GGGEAAAKGSS | 13,924 | KORV_Q9TTC1_3mutA |
| GGGGGSPAP | 13,925 | AVIRE_P03360_3mut |
| GGGGGSEAAAK | 13,926 | SFV3L_P27401_2mutA |
| GGS | | KORV_Q9TTC1_3mutA |
| GGGGGGG | 13,928 | PERV_Q4VFZ2_3mut |
| SGSETPGTSESATPES | 13,929 | SFV3L_P27401_2mutA |
| EAAAKGGSGGG | 13,930 | MLVMS_P03355_3mut |
| GGGGS | 13,931 | MLVFF_P26809_3mut |
| EAAAKGSSGGG | 13,932 | BAEVM_P10272_3mut |
| EAAAKPAPGGS | 13,933 | MLVF5_P26810_3mutA |
| SGGSSGGSSGSETPGTSESATPESSGGSSGGSS | 13,934 | SFV3L_P27401_2mutA |
| GGSPAPGGG | 13,935 | WMSV_P03359_3mutA |
| GSAGSAAGSGEF | 13,936 | MLVFF_P26809_3mut |
| GGGGSSGGS | 13,937 | MLVMS_P03355_3mutA_WS |
| GGGGGGG | 13,938 | MLVCB_P08361_3mut |
| GSSEAAAK | 13,939 | WMSV_P03359_3mut |
| PAPGSS | 13,940 | FLV_P10273_3mutA |
| GSSGGG | 13,941 | PERV_Q4VFZ2_3mutA_WS |
| PAPGGG | 13,942 | MLVFF_P26809_3mut |
| GGGGGSPAP | 13,943 | MLVMS_P03355_3mut |
| GGSEAAAK | 13,944 | XMRV6_A1Z651_3mut |
| GSSGGG | 13,945 | PERV_Q4VFZ2_3mut |
| GGSGGSGGSGGS | 13,946 | MLVMS_P03355_3mut |
| PAPAP | 13,947 | AVIRE_P03360_3mut |
| GGSEAAAK | 13,948 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGS | 13,949 | MLVMS_P03355_PLV919 |
| GGGG | 13,950 | BAEVM_P10272_3mutA |
| EAAAKGGGGSS | 13,951 | MLVCB_P08361_3mutA |
| EAAAKEAAAKEAAAK | 13,952 | GALV_P21414_3mutA |
| PAPGGGEAAAK | 13,953 | KORV_Q9TTC1 |
| EAAAKGGSPAP | 13,954 | MLVMS_P03355_3mut |
| GGSGSSEAAAK | 13,955 | MLVMS_P03355_3mut |
| GGSPAPEAAAK | 13,956 | FLV_P10273_3mutA |
| GGGGGGG | 13,957 | PERV_Q4VFZ2_3mut |
| EAAAKEAAAKEAAAKEAAAKEAAAK | 13,958 | SFV1_P23074_2mutA |
| EAAAKGSSGGS | 13,959 | MLVMS_P03355_3mut |
| GSSEAAAKPAP | 13,960 | MLVFF_P26809_3mut |
| GGGGSS | 13,961 | FLV_P10273_3mutA |
| EAAAKGGSGGG | 13,962 | AVIRE_P03360_3mutA |
| GGSGGS | 13,963 | PERV_Q4VFZ2_3mutA_WS |
| GGGGGSPAP | 13,964 | AVIRE_P03360_3mutA |
| EAAAKEAAAKEAAAK | 13,965 | XMRV6_A1Z651_3mut |
| PAPEAAAKGGS | 13,966 | FLV_P10273_3mutA |
| GSSGGSEAAAK | 13,967 | MLVCB_P08361_3mut |
| EAAAKGGSGGG | 13,968 | MLVMS_P03355 |
| GGSGGGPAP | 13,969 | MLVMS_P03355_3mut |
| GGS | | XMRV6_A1Z651_3mut |
| GGSEAAAKPAP | 13,971 | MLVFF_P26809_3mut |
| EAAAKGGG | 13,972 | MLVMS_P03355_PLV919 |
| GSSGSSGSSGSS | 13,973 | WMSV_P03359_3mut |
| GGSGSSPAP | 13,974 | PERV_Q4VFZ2_3mut |
| GGGEAAAK | 13,975 | MLVMS_P03355_3mutA_WS |
| GSSPAPGGS | 13,976 | KORV_Q9TTC1-Pro_3mutA |
| GSSEAAAKGGG | 13,977 | SFV3L_P27401_2mut |
| EAAAKPAPGGS | 13,978 | MLVCB_P08361_3mut |
| GGSGGGEAAAK | 13,979 | PERV_Q4VFZ2 |
| GGSGSS | 13,980 | MLVCB_P08361_3mut |
| GGSGGGEAAAK | 13,981 | MLVBM_Q7SVK7_3mutA_WS |
| GGSGGSGGSGGSGGSGGS | 13,982 | FLV_P10273_3mut |
| PAPEAAAKGSS | 13,983 | MLVMS_P03355_3mut |
| EAAAKGSSGGS | 13,984 | WMSV_P03359_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGSGSSEAAAK | 13,985 | MLVCB_P08361_3mut |
| GGSGSSEAAAK | 13,986 | KORV_Q9TTC1_3mutA |
| GSSGGSGGG | 13,987 | MLVMS_P03355_PLV919 |
| EAAAKGGSGGG | 13,988 | SFV3L_P27401-Pro_2mutA |
| GGSGGS | 13,989 | AVIRE_P03360_3mutA |
| GSAGSAAGSGEF | 13,990 | MLVMS_P03355_PLV919 |
| GGSGSS | 13,991 | GALV_P21414_3mutA |
| GGGG | 13,992 | MLVFF_P26809_3mutA |
| GGGGSGGGGSGGGGSGGGGS | 13,993 | WMSV_P03359_3mut |
| SGSETPGTSESATPES | 13,994 | BAEVM_P10272_3mut |
| EAAAKEAAAKEAAAKEAAAK | 13,995 | FOAMV_P14350_2mutA |
| GGGEAAAKGGS | 13,996 | FLV_P10273_3mutA |
| GSSGGSEAAAK | 13,997 | MLVFF_P26809_3mut |
| EAAAKGGGGSS | 13,998 | MLVAV_P03356_3mut |
| PAPGGSEAAAK | 13,999 | KORV_Q9TTC1-Pro_3mut |
| EAAAK | 14,000 | XMRV6_A1Z651_3mut |
| GSSGSSGSSGSSGSSGSS | 14,001 | PERV_Q4VFZ2_3mut |
| GGGG | 14,002 | MLVCB_P08361_3mutA |
| GSSGSS | 14,003 | WMSV_P03359_3mutA |
| GSSGGSPAP | 14,004 | AVIRE_P03360_3mut |
| GGSGGSGGS | 14,005 | MLVCB_P08361_3mut |
| EAAAKGGGPAP | 14,006 | FLV_P10273_3mutA |
| GGGGSGGGGS | 14,007 | MLVCB_P08361_3mut |
| GGSEAAAKGSS | 14,008 | PERV_Q4VFZ2_3mutA_WS |
| EAAAKEAAAKEAAAKEAAAKEAAAK | 14,009 | SFV3L_P27401_2mutA |
| GGSGSSEAAAK | 14,010 | PERV_Q4VFZ2_3mutA_WS |
| EAAAKEAAAKEAAAKEAAAK | 14,011 | SFV3L_P27401-Pro_2mutA |
| GSSEAAAKGGS | 14,012 | FLV_P10273_3mutA |
| GGSGSS | 14,013 | PERV_Q4VFZ2 |
| GGSGSSEAAAK | 14,014 | SFV3L_P27401-Pro_2mutA |
| GSSGSSGSS | 14,015 | XMRV6_A1Z651_3mut |
| EAAAKGSSPAP | 14,016 | KORV_Q9TTC1_3mutA |
| EAAAKPAP | 14,017 | FLV_P10273_3mutA |
| GGSGSSEAAAK | 14,018 | KORV_Q9TTC1-Pro_3mut |
| GGGGSGGGGSGGGGSGGGGSGGGGSGGGGS | 14,019 | KORV_Q9TTC1_3mutA |
| GGGGSGGGGSGGGGS | 14,020 | KORV_Q9TTC1-Pro_3mutA |
| GGGGGGG | 14,021 | FLV_P10273_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGSS | 14,022 | WMSV_P03359_3mut |
| EAAAKGGGPAP | 14,023 | MLVCB_P08361_3mut |
| GSSGSS | 14,024 | MLVBM_Q7SVK7_3mutA_WS |
| EAAAKGGGGS | 14,025 | MLVFF_P26809_3mut |
| GGSGGGEAAAK | 14,026 | FLV_P10273_3mutA |
| PAPGSS | 14,027 | MLVFF_P26809_3mutA |
| PAPGSS | 14,028 | BAEVM_P10272_3mutA |
| GGSPAPGSS | 14,029 | AVIRE_P03360_3mut |
| GGGGSSEAAAK | 14,030 | MLVMS_P03355_3mut |
| GSSGGGGS | 14,031 | FFV_093209-Pro |
| EAAAKGSSPAP | 14,032 | PERV_Q4VFZ2_3mut |
| GSSPAPGGS | 14,033 | PERV_Q4VFZ2_3mut |
| GGGGGG | 14,034 | BAEVM_P10272_3mut |
| EAAAKGGGSS | 14,035 | PERV_Q4VFZ2_3mutA_WS |
| PAPGGSEAAAK | 14,036 | KORV_Q9TTC1_3mutA |
| SGGSSGGSSGSETPGTSESATPESSGGSSGGSS | 14,037 | MLVMS_P03355_3mutA_WS |
| GSSGSSGSSGSS | 14,038 | MLVMS_P03355_3mut |
| EAAAKGSSGGG | 14,039 | MLVMS_P03355_PLV919 |
| GGSEAAAKPAP | 14,040 | AVIRE_P03360_3mutA |
| GSSGSSGSSGSSGSS | 14,041 | WMSV_P03359_3mutA |
| GGGEAAAKPAP | 14,042 | FLV_P10273_3mutA |
| PAPGSSGGG | 14,043 | KORV_Q9TTC1_3mutA |
| GSSGSS | 14,044 | MLVMS_P03355_3mutA_WS |
| PAPEAAAK | 14,045 | BAEVM_P10272_3mut |
| GGGPAPGSS | 14,046 | PERV_Q4VFZ2 |
| GSSGGSPAP | 14,047 | MLVFF_P26809_3mut |
| GGGGSS | 14,048 | SFV3L_P27401_2mut |
| PAPEAAAKGSS | 14,049 | SFV3L_P27401_2mut |
| GGSGGGPAP | 14,050 | XMRV6_A1Z651_3mutA |
| PAPGGS | 14,051 | BAEVM_P10272_3mutA |
| EAAAKGGGGS | 14,052 | AVIRE_P03360_3mut |
| GSSGGSPAP | 14,053 | KORV_Q9TTC1-Pro_3mutA |
| GSSGGGGS | 14,054 | WMSV_P03359_3mut |
| GGGEAAAKGSS | 14,055 | AVIRE_P03360_3mut |
| GGGEAAAKGSS | 14,056 | BAEVM_P10272_3mut |
| PAPEAAAKGSS | 14,057 | MLVAV_P03356_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGSSGSSGSSGSS | 14,058 | MLVCB_P08361_3mut |
| GGSPAPGSS | 14,059 | FLV_P10273_3mutA |
| EAAAKGSSPAP | 14,060 | BAEVM_P10272_3mutA |
| GGSGGSGGSGGSGGSGGS | 14,061 | PERV_Q4VFZ2 |
| GGGGSSEAAAK | 14,062 | FLV_P10273_3mutA |
| GGGGSSPAP | 14,063 | FFV_093209 |
| GSSGGSPAP | 14,064 | MLVMS_P03355_3mut |
| GGGPAPGSS | 14,065 | MLVMS_P03355_PLV919 |
| PAPGSSGGS | 14,066 | PERV_Q4VFZ2_3mut |
| GGGGGSPAP | 14,067 | MLVFF_P26809_3mut |
| SGSETPGTSESATPES | 14,068 | MLVMS_P03355_3mutA_WS |
| GSSGSSGSSGSSGSS | 14,069 | KORV_Q9TTC1_3mutA |
| GSSPAPGGG | 14,070 | WMSV_P03359_3mut |
| PAPAPAPAPAPAP | 14,071 | SFV3L_P27401_2mutA |
| GGGPAPGGS | 14,072 | MLVMS_P03355_3mut |
| PAPGGSEAAAK | 14,073 | WMSV_P03359_3mut |
| GGGGSSEAAAK | 14,074 | FFV_093209-Pro |
| GGSPAPGGG | 14,075 | FLV_P10273_3mutA |
| GSSPAPEAAAK | 14,076 | AVIRE_P03360_3mut |
| GGGEAAAK | 14,077 | FLV_P10273_3mutA |
| PAPEAAAKGGG | 14,078 | MLVCB_P08361_3mut |
| GGSPAPGGG | 14,079 | MLVCB_P08361_3mut |
| GGSGGGGSS | 14,080 | BAEVM_P10272_3mutA |
| GSSPAPEAAAK | 14,081 | MLVCB_P08361_3mut |
| GGSPAPGGG | 14,082 | KORV_Q9TTC1-Pro_3mutA |
| PAPGGSGSS | 14,083 | KORV_Q9TTC1_3mutA |
| GSSPAP | 14,084 | KORV_Q9TTC1-Pro_3mutA |
| SGSETPGTSESATPES | 14,085 | MLVMS_P03355 |
| GSSGSSGSS | 14,086 | MLVAV_P03356_3mutA |
| PAPGSSGGS | 14,087 | PERV_Q4VFZ2_3mutA_WS |
| PAPGGS | 14,088 | KORV_Q9TTC1-Pro_3mutA |
| PAPEAAAKGGG | 14,089 | SFV3L_P27401-Pro_2mutA |
| GGSGGSGGS | 14,090 | BAEVM_P10272_3mut |
| PAPGGS | 14,091 | MLVFF_P26809_3mut |
| GSSGGSPAP | 14,092 | MLVMS_P03355_PLV919 |
| GSSGGGGGS | 14,093 | FLV_P10273_3mutA |
| GGGGGSPAP | 14,094 | KORV_Q9TTC1-Pro_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKPAPGSS | 14,095 | SFV3L_P27401-Pro_2mutA |
| EAAAKGGSPAP | 14,096 | KORV_Q9TTC1-Pro |
| GGGPAPEAAAK | 14,097 | MLVMS_P03355_PLV919 |
| GGSEAAAKGSS | 14,098 | MLVMS_P03355 |
| PAPEAAAKGSS | 14,099 | KORV_Q9TTC1_3mutA |
| PAPEAAAKGGS | 14,100 | WMSV_P03359_3mutA |
| GSSGGG | 14,101 | PERV_Q4VFZ2_3mutA_WS |
| EAAAKGGGGSS | 14,102 | MLVMS_P03355_PLV919 |
| EAAAKGGSPAP | 14,103 | AVIRE_P03360_3mutA |
| GGGGSSGGS | 14,104 | MLVMS_P03355_PLV919 |
| PAPEAAAKGSS | 14,105 | PERV_Q4VFZ2_3mutA_WS |
| EAAAKGGGGGS | 14,106 | BAEVM_P10272_3mut |
| GSSGGGGGS | 14,107 | MLVMS_P03355_3mut |
| PAPAPAPAP | 14,108 | KORV_Q9TTC1_3mutA |
| GGSGGSGGSGGS | 14,109 | MLVAV_P03356_3mut |
| PAPAPAPAP | 14,110 | SFV3L_P27401_2mut |
| GSSEAAAKPAP | 14,111 | MLVMS_P03355_3mut |
| GGSGGGEAAAK | 14,112 | SFV3L_P27401_2mutA |
| GSSGGSGGG | 14,113 | MLVMS_P03355_3mutA_WS |
| GGGGGSPAP | 14,114 | MLVCB_P08361_3mutA |
| GGGEAAAKGSS | 14,115 | XMRV6_A1Z651_3mutA |
| GGGGSSPAP | 14,116 | BAEVM_P10272_3mut |
| GGSGGG | 14,117 | PERV_Q4VFZ2_3mut |
| GGGGSS | 14,118 | MLVBM_Q7SVK7_3mutA_WS |
| EAAAKGSSGGS | 14,119 | PERV_Q4VFZ2_3mutA_WS |
| GSSGGGGGS | 14,120 | PERV_Q4VFZ2 |
| EAAAKGSSGGS | 14,121 | PERV_Q4VFZ2_3mut |
| EAAAKEAAAK | 14,122 | MLVAV_P03356_3mut |
| GSSGGGEAAAK | 14,123 | MLVAV_P03356_3mut |
| GSSPAPGGG | 14,124 | XMRV6_A1Z651_3mut |
| GGGGSGGGGSGGGGS | 14,125 | PERV_Q4VFZ2_3mut |
| EAAAKEAAAKEAAAKEAAAK | 14,126 | KORV_Q9TTC1_3mutA |
| EAAAKGGSGSS | 14,127 | MLVBM_Q7SVK7_3mut |
| PAPEAAAK | 14,128 | BLVJ_P03361 |
| GSSGGG | 14,129 | FFV_093209-Pro |
| GGSGGGEAAAK | 14,130 | KORV_Q9TTC1-Pro_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAK | 14,131 | FLV_P10273_3mutA |
| GGGGSSPAP | 14,132 | MLVMS_P03355_3mut |
| GSS | | SFV3L_P27401-Pro_2mut |
| PAPEAAAKGSS | 14,134 | BAEVM_P10272_3mut |
| GGGGGSPAP | 14,135 | PERV_Q4VFZ2_3mut |
| GSSGSSGSS | 14,136 | BAEVM_P10272_3mutA |
| GGGGSGGGGSGGGGSGGGGS | 14,137 | SFV1_P23074_2mut |
| GGGGSSEAAAK | 14,138 | SFV3L_P27401_2mutA |
| GGGGSGGGGSGGGGGGGGS | 14,139 | FOAMV_P14350-Pro_2mut |
| PAPGSSEAAAK | 14,140 | MLVBM_Q7SVK7_3mutA_WS |
| GGGGGSGSS | 14,141 | MLVFF_P26809_3mutA |
| GGSEAAAKGGG | 14,142 | MLVBM_Q7SVK7_3mut |
| PAPGSSGGG | 14,143 | PERV_Q4VFZ2 |
| GGS | | PERV_Q4VFZ2_3mutA_WS |
| EAAAKGGSGSS | 14,145 | FLV_P10273_3mut |
| GGGEAAAK | 14,146 | WMSV_P03359_3mutA |
| GGSEAAAKPAP | 14,147 | MLVBM_Q7SVK7_3mut |
| SGSETPGTSESATPES | 14,148 | FOAMV_P14350-Pro_2mutA |
| EAAAKPAPGGS | 14,149 | AVIRE_P03360_3mut |
| EAAAKGGGGS | 14,150 | KORV_Q9TTC1-Pro_3mutA |
| GGGGS | 14,151 | PERV_Q4VFZ2_3mut |
| GGSEAAAKGSS | 14,152 | MLVFF_P26809_3mutA |
| GGSEAAAKGGG | 14,153 | AVIRE_P03360 |
| GGSGGSGGSGGSGGSGGS | 14,154 | SFV3L_P27401_2mut |
| GGSEAAAKGSS | 14,155 | SFV3L_P27401-Pro_2mutA |
| GGGEAAAKPAP | 14,156 | MLVCB_P08361_3mut |
| GGSEAAAK | 14,157 | MLVMS_P03355_PLV919 |
| GGSPAPGSS | 14,158 | KORV_Q9TTC1-Pro_3mutA |
| GSSPAPEAAAK | 14,159 | WMSV_P03359_3mutA |
| GGSGSS | 14,160 | KORV_Q9TTC1-Pro_3mutA |
| PAPGGGGGS | 14,161 | AVIRE_P03360_3mut |
| PAPEAAAKGSS | 14,162 | FFV_093209-Pro |
| GGSGGGEAAAK | 14,163 | WMSV_P03359_3mut |
| PAPGGG | 14,164 | MLVMS_P03355_3mut |
| EAAAKGGG | 14,165 | FLV_P10273_3mutA |
| GSSGSSGSSGSS | 14,166 | MLVCB_P08361_3mut |
| EAAAKGGSGGG | 14,167 | FFV_093209 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSPAPGGS | 14,168 | PERV_Q4VFZ2_3mutA_WS |
| GSSPAPGGS | 14,169 | MLVCB_P08361_3mut |
| GGGPAP | 14,170 | WMSV_P03359_3mutA |
| GGGPAP | 14,171 | KORV_Q9TTC1_3mutA |
| GGSPAPGSS | 14,172 | KORV_Q9TTC1-Pro_3mut |
| PAPAP | 14,173 | MLVMS_P03355_3mut |
| GGGGGG | 14,174 | MLVMS_P03355_3mut |
| GGGGG | 14,175 | KORV_Q9TTC1-Pro_3mut |
| GSAGSAAGSGEF | 14,176 | FOAMV_P14350_2mutA |
| PAPAP | 14,177 | KORV_Q9TTC1-Pro_3mutA |
| GGSEAAAKGGG | 14,178 | SFV3L_P27401-Pro_2mutA |
| PAPAP | 14,179 | WMSV_P03359_3mut |
| GGGGSGGGGSGGGGS | 14,180 | SFV3L_P27401_2mut |
| PAPGGS | 14,181 | KORV_Q9TTC1_3mutA |
| GGGEAAAKPAP | 14,182 | FLV_P10273_3mut |
| GGGGGS | 14,183 | MLVAV_P03356_3mutA |
| GSSEAAAKGGG | 14,184 | WMSV_P03359_3mut |
| EAAAKGGGSS | 14,185 | GALV_P21414_3mutA |
| GSSGGS | 14,186 | MLVAV_P03356_3mutA |
| GSSGGG | 14,187 | MLVBM_Q7SVK7_3mut |
| PAPAPAP | 14,188 | SFV3L_P27401-Pro_2mutA |
| GGGG | 14,189 | KORV_Q9TTC1_3mutA |
| EAAAKPAPGGS | 14,190 | MLVFF_P26809_3mut |
| GGGGSGGGGS | 14,191 | XMRV6_A1Z651_3mut |
| EAAAKGGG | 14,192 | MLVCB_P08361_3mut |
| GGGGSSPAP | 14,193 | KORV_Q9TTC1_3mutA |
| GSSEAAAKGGG | 14,194 | KORV_Q9TTC1-Pro_3mutA |
| GGGGG | 14,195 | BLVJ_P03361_2mutB |
| GGGEAAAKGSS | 14,196 | FFV_O93209-Pro |
| GSSGSSGSS | 14,197 | BAEVM_P10272_3mut |
| GSSGGSPAP | 14,198 | PERV_Q4VFZ2_3mut |
| EAAAKGGS | 14,199 | KORV_Q9TTC1_3mutA |
| GGSPAPEAAAK | 14,200 | AVIRE_P03360_3mut |
| GGSEAAAK | 14,201 | WMSV_P03359_3mut |
| GSSGGS | 14,202 | KORV_Q9TTC1-Pro_3mutA |
| GGGPAPEAAAK | 14,203 | KORV_Q9TTC1_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGSS | 14,204 | WMSV_P03359_3mutA |
| GGSEAAAKGSS | 14,205 | FLV_P10273_3mutA |
| EAAAKEAAAKEAAAKEAAAKEAAAK | 14,206 | SFV3L_P27401 |
| GSSEAAAKGGG | 14,207 | SFV3L_P27401-Pro_2mutA |
| GGGGSEAAAKGGGGS | 14,208 | KORV_Q9TTC1-Pro_3mutA |
| GGSGGSGGS | 14,209 | WMSV_P03359_3mut |
| GGGGGSGSS | 14,210 | KORV_Q9TTC1-Pro |
| GGGGSGGGGSGGGGSGGGGS | 14,211 | MLVMS_P03355_3mut |
| EAAAKGGG | 14,212 | PERV_Q4VFZ2 |
| GGSEAAAKGGG | 14,213 | KORV_Q9TTC1-Pro_3mut |
| GSSGGSGGG | 14,214 | PERV_Q4VFZ2_3mutA_WS |
| GGGGS | 14,215 | PERV_Q4VFZ2_3mut |
| GSAGSAAGSGEF | 14,216 | PERV_Q4VFZ2 |
| PAPEAAAKGSS | 14,217 | BAEVM_P10272_3mutA |
| GSSPAPGGG | 14,218 | MLVCB_P08361_3mut |
| GGGGSSPAP | 14,219 | KORV_Q9TTC1-Pro_3mutA |
| PAPGGSGGG | 14,220 | MLVFF_P26809_3mut |
| GSSPAP | 14,221 | KORV_Q9TTC1_3mutA |
| PAPGSS | 14,222 | SFV3L_P27401-Pro_2mut |
| GGSGGGGSS | 14,223 | MLVMS_P03355_PLV919 |
| GSSGGS | 14,224 | WMSV_P03359_3mutA |
| EAAAKGGGGS | 14,225 | PERV_Q4VFZ2 |
| GGGGG | 14,226 | KORV_Q9TTC1_3mutA |
| EAAAKGSS | 14,227 | MLVMS_P03355_PLV919 |
| EAAAKEAAAKEAAAKEAAAKEAAAK | 14,228 | FLV_P10273_3mut |
| EAAAKEAAAKEAAAKEAAAK | 14,229 | SFV3L_P27401-Pro_2mut |
| GSAGSAAGSGEF | 14,230 | SFV3L_P27401_2mutA |
| GGGPAPGGS | 14,231 | FLV_P10273_3mutA |
| GGSEAAAKGGG | 14,232 | MLVCB_P08361_3mut |
| PAPGGGEAAAK | 14,233 | BAEVM_P10272_3mut |
| EAAAKPAPGSS | 14,234 | FOAMV_P14350_2mut |
| GGSEAAAK | 14,235 | KORV_Q9TTC1_3mutA |
| GGSGSS | 14,236 | AVIRE_P03360 |
| GGSPAPEAAAK | 14,237 | MLVMS_P03355_PLV919 |
| GGGGS | 14,238 | XMRV6_A1Z651_3mut |
| GGSPAPGGG | 14,239 | XMRV6_A1Z651_3mut |
| EAAAKPAPGGS | 14,240 | PERV_Q4VFZ2 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSPAP | 14,241 | BAEVM_P10272_3mut |
| GGSGSSGGG | 14,242 | FLV_P10273_3mutA |
| PAPGGG | 14,243 | PERV_Q4VFZ2_3mutA_WS |
| GSSGGSEAAAK | 14,244 | MLVBM_Q7SVK7_3mut |
| GGSEAAAK | 14,245 | MLVMS_P03355_3mut |
| GGGPAPGGS | 14,246 | MLVFF_P26809_3mut |
| GSAGSAAGSGEF | 14,247 | MLVBM_Q7SVK7_3mutA_WS |
| EAAAKPAPGGS | 14,248 | SFVCP_Q87040 |
| PAPGGG | 14,249 | PERV_Q4VFZ2_3mutA_WS |
| GSSPAPEAAAK | 14,250 | MLVBM_Q7SVK7 |
| PAPEAAAK | 14,251 | MLVBM_Q7SVK7_3mut |
| PAPGGGGS | 14,252 | AVIRE_P03360_3mutA |
| GGSEAAAKPAP | 14,253 | MLVBM_Q7SVK7_3mut |
| EAAAKGSS | 14,254 | WMSV_P03359_3mutA |
| GGGEAAAK | 14,255 | MLVFF_P26809_3mutA |
| EAAAKEAAAKEAAAK | 14,256 | MLVMS_P03355_3mut |
| PAPEAAAKGGG | 14,257 | BAEVM_P10272_3mut |
| PAPAPAP | 14,258 | MLVCB_P08361_3mut |
| EAAAKPAPGGS | 14,259 | BAEVM_P10272_3mut |
| GGGGSGGGGS | 14,260 | FLV_P10273_3mut |
| GGGGSEAAAKGGGGS | 14,261 | KORV_Q9TTC1_3mut |
| EAAAK | 14,262 | FLV_P10273_3mut |
| PAPAPAP | 14,263 | WMSV_P03359_3mut |
| GGGGSEAAAKGGGGS | 14,264 | FFV_093209-Pro |
| GGSPAPEAAAK | 14,265 | MLVMS_P03355_3mut |
| GGSGSSGGG | 14,266 | XMRV6_A1Z651_3mut |
| GGSPAPGSS | 14,267 | PERV_Q4VFZ2_3mut |
| SGGSSGGSSGSETPGTSESATPESSGGSSGGSS | 14,268 | SFV3L_P27401-Pro_2mutA |
| EAAAKGGGPAP | 14,269 | BAEVM_P10272_3mutA |
| GSSGGSEAAAK | 14,270 | MLVMS_P03355_3mutA_WS |
| SGSETPGTSESATPES | 14,271 | PERV_Q4VFZ2_3mutA_WS |
| EAAAKEAAAKEAAAKEAAAKEAAAK | 14,272 | KORV_Q9TTC1-Pro_3mutA |
| GSSGSSGSS | 14,273 | KORV_Q9TTC1_3mutA |
| GSSPAPGGG | 14,274 | SFV3L_P27401-Pro_2mutA |
| GSSGGGEAAAK | 14,275 | KORV_Q9TTC1_3mutA |
| GGSGGGGSS | 14,276 | PERV_Q4VFZ2_3mutA_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGGEAAAK | 14,277 | MLVCB_P08361_3mut |
| GSSEAAAKGGG | 14,278 | MLVCB_P08361_3mut |
| GGSGGGGSS | 14,279 | KORV_Q9TTC1_3mutA |
| GGSGSSPAP | 14,280 | PERV_Q4VFZ2_3mutA_WS |
| GSSPAP | 14,281 | MLVMS_P03355_3mut |
| GGGGSSEAAAK | 14,282 | AVIRE_P03360 |
| GGS | | WMSV_P03359_3mut |
| EAAAKEAAAK | 14,284 | PERV_Q4VFZ2_3mut |
| PAPAPAPAP | 14,285 | MLVAV_P03356_3mut |
| GGSEAAAKGGG | 14,286 | KORV_Q9TTC1_3mutA |
| PAPGGG | 14,287 | MLVAV_P03356_3mut |
| EAAAKGSS | 14,288 | BAEVM_P10272_3mut |
| GGGGSGGGGS | 14,289 | WMSV_P03359_3mutA |
| GGSGGSGGS | 14,290 | SFV3L_P27401_2mut |
| EAAAK | 14,291 | MLVCB_P08361_3mut |
| GGGGSSGGS | 14,292 | WMSV_P03359_3mutA |
| GGGPAPEAAAK | 14,293 | MLVAV_P03356_3mutA |
| EAAAKEAAAKEAAAK | 14,294 | FFV_093209 |
| GSSEAAAKGGG | 14,295 | MLVBM_Q7SVK7_3mut |
| GGGPAPGGS | 14,296 | FLV_P10273_3mut |
| GGSEAAAKGGG | 14,297 | WMSV_P03359_3mut |
| EAAAKGGGGS | 14,298 | XMRV6_A1Z651_3mutA |
| EAAAKGGSGGG | 14,299 | FLV_P10273_3mutA |
| GGSEAAAKGGG | 14,300 | SFV3L_P27401_2mutA |
| GGGGS | 14,301 | PERV_Q4VFZ2_3mutA_WS |
| GSSGGS | 14,302 | MLVMS_P03355_3mut |
| GSSGSS | 14,303 | MLVAV_P03356_3mutA |
| GGSPAPGGG | 14,304 | MLVBM_Q7SVK7_3mutA_WS |
| GSSGGGGGS | 14,305 | MLVF5_P26810_3mut |
| PAPAPAPAP | 14,306 | MLVCB_P08361_3mut |
| PAPAP | 14,307 | PERV_Q4VFZ2_3mutA_WS |
| PAPGSSGGS | 14,308 | KORV_Q9TTC1_3mut |
| PAPGSSGGG | 14,309 | PERV_Q4VFZ2_3mut |
| GGGEAAAK | 14,310 | MLVMS_P03355_PLV919 |
| GGSGGSGGSGGSGGS | 14,311 | SFV3L_P27401-Pro_2mutA |
| GGSGGG | 14,312 | FLV_P10273_3mut |
| PAPEAAAKGGG | 14,313 | MLVFF_P26809_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| PAP | | PERV_Q4VFZ2_3mutA_WS |
| PAPGGSGSS | 14,315 | FFV_093209_2mut |
| EAAAKEAAAKEAAAKEAAAKEAAAKEAAAK | 14,316 | FFV_093209-Pro_2mut |
| GSSGSSGSSGSS | 14,317 | FFV_093209-Pro |
| GSSGSSGSSGSSGSS | 14,318 | FLV_P10273_3mutA |
| GGGEAAAKPAP | 14,319 | PERV_Q4VFZ2 |
| PAPGSSGGG | 14,320 | SFV3L_P27401_2mut |
| PAPGGSGSS | 14,321 | KORV_Q9TTC1-Pro_3mut |
| PAPAPAPAPAP | 14,322 | GALV_P21414_3mutA |
| GGSGGGEAAAK | 14,323 | PERV_Q4VFZ2_3mut |
| GSSPAP | 14,324 | MLVCB_P08361_3mut |
| EAAAKPAP | 14,325 | MLVF5_P26810_3mut |
| GGGGSGGGGSGGGGSGGGGS | 14,326 | MLVBM_Q7SVK7_3mut |
| GGSGGG | 14,327 | WMSV_P03359_3mut |
| GGSGGSGGS | 14,328 | KORV_Q9TTC1_3mut |
| GGGGGGGG | 14,329 | MLVFF_P26809_3mut |
| GGGGSS | 14,330 | MLVAV_P03356_3mut |
| GSSGGGGGS | 14,331 | SFV3L_P27401_2mut |
| EAAAKEAAAKEAAAKEAAAKEAAAK | 14,332 | GALV_P21414_3mutA |
| GSSGSSGSS | 14,333 | PERV_Q4VFZ2_3mut |
| GSSPAPGGS | 14,334 | MLVFF_P26809_3mut |
| PAPAPAP | 14,335 | AVIRE_P03360_3mutA |
| EAAAKEAAAKEAAAKEAAAK | 14,336 | WMSV_P03359_3mutA |
| PAPAPAPAP | 14,337 | SFV3L_P27401_2mutA |
| GGGGSS | 14,338 | MLVAV_P03356_3mutA |
| GSSGSSGSSGSSGSS | 14,339 | SFV3L_P27401_2mutA |
| PAPGGS | 14,340 | WMSV_P03359_3mutA |
| GSSEAAAKGGG | 14,341 | PERV_Q4VFZ2 |
| GSSGGSPAP | 14,342 | MLVMS_P03355_PLV919 |
| GSSGSSGSSGSSGSSGSS | 14,343 | SFV3L_P27401_2mutA |
| GGSGSSGGG | 14,344 | MLVCB_P08361_3mut |
| GGGPAPGSS | 14,345 | SFV3L_P27401-Pro_2mutA |
| GSSEAAAKGGS | 14,346 | WMSV_P03359_3mut |
| GSSEAAAKGGG | 14,347 | MLVAV_P03356_3mut |
| GGSGGGPAP | 14,348 | FFV_093209-Pro |
| GSSGSS | 14,349 | PERV_Q4VFZ2_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGGGGS | 14,350 | GALV_P21414_3mutA |
| EAAAKPAPGGS | 14,351 | MLVAV_P03356_3mut |
| GSSGSS | 14,352 | MLVMS_P03355_3mut |
| EAAAKPAPGGS | 14,353 | FFV_093209-Pro |
| GGGPAPEAAAK | 14,354 | MLVMS_P03355_3mutA_WS |
| GSSEAAAKGGG | 14,355 | MLVBM_Q7SVK7_3mut |
| GGGEAAAKGGS | 14,356 | BAEVM_P10272_3mut |
| GSSGSS | 14,357 | KORV_Q9TTC1-Pro_3mutA |
| EAAAKEAAAKEAAAK | 14,358 | SFV1_P23074 |
| PAPGSSGGS | 14,359 | KORV_Q9TTC1-Pro_3mut |
| PAPAPAPAPAP | 14,360 | MLVMS_P03355 |
| GSSEAAAK | 14,361 | SFV3L_P27401_2mut |
| PAP | | PERV_Q4VFZ2_3mut |
| GGSEAAAKGGG | 14,363 | MLVBM_Q7SVK7_3mut |
| GGSGGGPAP | 14,364 | MLVBM_Q7SVK7_3mutA_WS |
| GSSGSS | 14,365 | MLVMS_P03355_3mut |
| GGSEAAAK | 14,366 | MLVMS_P03355 |
| GSSEAAAKGGS | 14,367 | MLVMS_P03355_PLV919 |
| PAPGGGGS | 14,368 | MLVFF_P26809_3mut |
| GSSGGG | 14,369 | PERV_Q4VFZ2_3mut |
| GSSGGS | 14,370 | PERV_Q4VFZ2_3mutA_WS |
| PAPGGG | 14,371 | BAEVM_P10272_3mut |
| PAPGSSGGG | 14,372 | MLVBM_Q7SVK7_3mut |
| GGSEAAAK | 14,373 | SFV3L_P27401_2mut |
| GSSPAPEAAAK | 14,374 | SFV3L_P27401-Pro_2mut |
| GSSGGSPAP | 14,375 | BAEVM_P10272_3mut |
| GGSPAPGSS | 14,376 | PERV_Q4VFZ2_3mutA_WS |
| GGSGGSGGS | 14,377 | PERV_Q4VFZ2 |
| GGSGGGPAP | 14,378 | FLV_P10273_3mut |
| GGGPAPEAAAK | 14,379 | SFV3L_P27401_2mutA |
| GGGGS | 14,380 | FLV_P10273_3mutA |
| GSSGGSGGG | 14,381 | XMRV6_A1Z651_3mut |
| EAAAKGGGGSS | 14,382 | PERV_Q4VFZ2 |
| GGSGSSGGG | 14,383 | SFV3L_P27401-Pro_2mutA |
| GGSGGSGGS | 14,384 | MLVFF_P26809_3mut |
| GGGPAPEAAAK | 14,385 | FLV_P10273_3mut |
| GSSGGGEAAAK | 14,386 | MLVMS_P03355_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGG | | SFV3L_P27401_2mut |
| GSAGSAAGSGEF | 14,388 | WMSV_P03359_3mut |
| GSSGGGPAP | 14,389 | MLVMS_P03355_PLV919 |
| GGGGSS | 14,390 | KORV_Q9TTC1-Pro_3mut |
| GGGGSSEAAAK | 14,391 | KORV_Q9TTC1 |
| PAPGGSGGG | 14,392 | SFV3L_P27401_2mut |
| GSSGSSGSSGSSGSS | 14,393 | FFV_093209 |
| GSSGGSPAP | 14,394 | MLVMS_P03355_3mut |
| GGSEAAAK | 14,395 | KORV_Q9TTC1-Pro_3mutA |
| GGGGSGGGGS | 14,396 | BAEVM_P10272_3mut |
| GSSEAAAKGGG | 14,397 | AVIRE_P03360_3mut |
| EAAAKPAPGGG | 14,398 | FLV_P10273_3mut |
| EAAAKGGSPAP | 14,399 | SFV3L_P27401-Pro_2mutA |
| GSSEAAAKPAP | 14,400 | MLVBM_Q7SVK7_3mut |
| GGGPAPGGS | 14,401 | MLVCB_P08361_3mut |
| GGG | | SFV3L_P27401_2mutA |
| EAAAKGGGGSEAAAK | 14,403 | SFV3L_P27401_2mutA |
| GGSGSSGGG | 14,404 | MLVBM_Q7SVK7_3mut |
| GSAGSAAGSGEF | 14,405 | BAEVM_P10272_3mut |
| GGGEAAAK | 14,406 | FOAMV_P14350_2mutA |
| PAPEAAAKGGS | 14,407 | WMSV_P03359_3mut |
| PAPAPAPAPAPAP | 14,408 | MLVF5_P26810_3mutA |
| GGSGGGGSS | 14,409 | FLV_P10273_3mutA |
| PAPGSSGGS | 14,410 | BAEVM_P10272_3mut |
| PAPEAAAK | 14,411 | WMSV_P03359_3mutA |
| GSSGSSGSSGSSGSSGSS | 14,412 | FFV_093209-Pro_2mut |
| GGGGGSGSS | 14,413 | FFV_093209-Pro |
| GGGGGGGG | 14,414 | SFV3L_P27401-Pro_2mutA |
| GGGGGG | 14,415 | FLV_P10273_3mut |
| GSSGGSGGG | 14,416 | MLVAV_P03356_3mutA |
| GGGGSS | 14,417 | SFV3L_P27401-Pro_2mutA |
| GGSGGGPAP | 14,418 | FOAMV_P14350_2mut |
| GSSGSS | 14,419 | AVIRE_P03360_3mutA |
| EAAAKEAAAKEAAAKEAAAKEAAAK | 14,420 | SFV3L_P27401-Pro_2mutA |
| EAAAKEAAAK | 14,421 | BAEVM_P10272_3mut |
| GSSPAPEAAAK | 14,422 | GALV_P21414_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGSEAAAKPAP | 14,423 | SFV3L_P27401_2mutA |
| GGSGGGEAAAK | 14,424 | SFV3L_P27401-Pro_2mutA |
| EAAAKGSSPAP | 14,425 | FOAMV_P14350_2mut |
| GGSGSSEAAAK | 14,426 | SFV3L_P27401_2mut |
| GGG | | PERV_Q4VFZ2 |
| GGGGGSGSS | 14,428 | FOAMV_P14350_2mut |
| GGSGGGEAAAK | 14,429 | KORV_Q9TTC1-Pro_3mut |
| GSSGGSGGG | 14,430 | AVIRE_P03360_3mutA |
| EAAAKPAPGGG | 14,431 | SFV3L_P27401_2mutA |
| PAPGGSGGG | 14,432 | KORV_Q9TTC1-Pro_3mut |
| PAPAPAP | 14,433 | WMSV_P03359_3mutA |
| GSSEAAAKPAP | 14,434 | SFV1_P23074 |
| SGGSSGGSSGSETPGTSESATPESSGGSSGGSS | 14,435 | SRV2_P51517 |
| GSSGGSGGG | 14,436 | PERV_Q4VFZ2_3mutA_WS |
| GSSGSSGSSGSSGSSGSS | 14,437 | FFV_O93209 |
| GSSGGGPAP | 14,438 | WMSV_P03359_3mut |
| PAPAPAPAPAPAP | 14,439 | MLVBM_Q7SVK7_3mut |
| GGGGGSPAP | 14,440 | KORV_Q9TTC1-Pro_3mutA |
| PAPGSS | 14,441 | MLVBM_Q7SVK7_3mutA_WS |
| PAPEAAAKGGS | 14,442 | SFV3L_P27401-Pro_2mut |
| GGGGSSPAP | 14,443 | MLVMS_P03355_3mut |
| GGSEAAAK | 14,444 | FFV_O93209-Pro |
| EAAAKPAPGGS | 14,445 | AVIRE_P03360_3mutA |
| PAPGSS | 14,446 | WMSV_P03359_3mut |
| PAPGSSGGG | 14,447 | SFV3L_P27401-Pro_2mutA |
| EAAAKEAAAKEAAAK | 14,448 | SFV3L_P27401_2mut |
| GGS | | MLVRD_P11227_3mut |
| GGGGS | 14,450 | KORV_Q9TTC1-Pro_3mut |
| GGSGGGGSS | 14,451 | KORV_Q9TTC1 |
| GGSGGG | 14,452 | MLVMS_P03355_3mutA_WS |
| GGGEAAAKPAP | 14,453 | BAEVM_P10272_3mut |
| EAAAKEAAAKEAAAKEAAAKEAAAK | 14,454 | FLV_P10273 |
| PAPGGSGGG | 14,455 | KORV_Q9TTC1-Pro_3mutA |
| GSSGSSGSSGSSGSSGSS | 14,456 | HTL1L_POC211 |
| GGGEAAAKPAP | 14,457 | WMSV_P03359 |
| GSSGGSPAP | 14,458 | FFV_O93209-Pro |
| PAPAPAPAPAP | 14,459 | SFV3L_P27401-Pro_2mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGSEAAAK | 14,460 | SFV3L_P27401_2mutA |
| GGSPAPGSS | 14,461 | SFV3L_P27401_2mut |
| GGSGGSGGS | 14,462 | KORV_Q9TTC1-Pro_3mut |
| PAPEAAAKGSS | 14,463 | KORV_Q9TTC1-Pro_3mut |
| EAAAKGGS | 14,464 | KORV_Q9TTC1_3mutA |
| EAAAKGGGGSEAAAK | 14,465 | SFV3L_P27401_Pro_2mut |
| GGGGSSPAP | 14,466 | FFV_093209-Pro |
| EAAAK | 14,467 | SFV3L_P27401_2mut |
| EAAAKGGGGSS | 14,468 | BAEVM_P10272_3mut |
| GGGGGSEAAAK | 14,469 | MLVBM_Q7SVK7_3mut |
| GGGG | 14,470 | PERV_Q4VFZ2 |
| GGGGGSEAAAK | 14,471 | FLV_P10273_3mut |
| EAAAKGGGPAP | 14,472 | KORV_Q9TTC1-Pro |
| GGGGSGGGGSGGGGSGGGGS | 14,473 | FFV_093209_2mutA |
| GSSGGSGGG | 14,474 | PERV_Q4VFZ2_3mut |
| GGGGSGGGGSGGGGS | 14,475 | GALV_P21414_3mutA |
| GGSGGGEAAAK | 14,476 | AVIRE_P03360_3mutA |
| PAPEAAAKGGG | 14,477 | SFV3L_P27401_2mut |
| GGGGSGGGGS | 14,478 | AVIRE_P03360 |
| GSSGGGEAAAK | 14,479 | SFV3L_P27401_2mutA |
| GGGGG | 14,480 | AVIRE_P03360_3mutA |
| GGSGSS | 14,481 | KORV_Q9TTC1_3mut |
| PAPAPAPAPAPAP | 14,482 | FOAMV_P14350_2mut |
| GGSEAAAKPAP | 14,483 | KORV_Q9TTC1-Pro_3mut |
| GGGGGG | 14,484 | PERV_Q4VFZ2_3mut |
| GSSGGGEAAAK | 14,485 | MLVBM_Q7SVK7 |
| SGGSSGGSSGSETPGTSESATPESSGGSSGGSS | 14,486 | MLVAV_P03356 |
| GGSPAPGSS | 14,487 | BAEVM_P10272_3mut |
| GGGGSSPAP | 14,488 | BAEVM_P10272 |
| GGGGSEAAAKGGGGS | 14,489 | SFV3L_P27401_2mut |
| GGGGGGGG | 14,490 | GALV_P21414_3mutA |
| PAPAP | 14,491 | MLVAV_P03356_3mut |
| GGGEAAAK | 14,492 | PERV_Q4VFZ2_3mutA_WS |
| GSSPAPGGG | 14,493 | FFV_093209_2mut |
| GGSGGSGGSGGSGGS | 14,494 | BAEVM_P10272 |
| GGGGGS | 14,495 | MLVF5_P26810_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGGGGSS | 14,496 | FLV_P10273_3mutA |
| GGGEAAAK | 14,497 | MLVBM_Q7SVK7_3mut |
| PAPEAAAKGGG | 14,498 | WMSV_P03359_3mut |
| GSSEAAAK | 14,499 | MLVBM_Q7SVK7_3mut |
| EAAAKEAAAK | 14,500 | AVIRE_P03360 |
| EAAAKGGGGS | 14,501 | MLVBM_Q7SVK7_3mut |
| GGGEAAAKGGS | 14,502 | SFV3L_P27401-Pro_2mutA |
| PAPAPAPAPAP | 14,503 | MLVF5_P26810_3mut |
| PAPGSSEAAAK | 14,504 | SFV3L_P27401-Pro_2mutA |
| EAAAKEAAAKEAAAK | 14,505 | BAEVM_P10272_3mutA |
| GGSPAPGSS | 14,506 | MLVMS_P03355 |
| PAPGSSGGS | 14,507 | FLV_P10273_3mutA |
| EAAAKEAAAKEAAAKEAAAK | 14,508 | FOAMV_P14350-Pro_2mut |
| EAAAKGGG | 14,509 | KORV_Q9TTC1_3mutA |
| EAAAKGGSGGG | 14,510 | MLVBM_Q7SVK7_3mut |
| GGGGGS | 14,511 | KORV_Q9TTC1-Pro_3mutA |
| PAPGGSGGG | 14,512 | WMSV_P03359_3mut |
| GGGPAPGGS | 14,513 | KORV_Q9TTC1_3mutA |
| GSS | | FFV_093209 |
| GGSGGSGGS | 14,515 | PERV_Q4VFZ2_3mut |
| GGGGS | 14,516 | GALV_P21414_3mutA |
| GGGG | 14,517 | MLVF5_P26810_3mut |
| GGSEAAAKPAP | 14,518 | FFV_093209-Pro_2mut |
| PAPAPAPAP | 14,519 | FFV_093209-Pro |
| PAP | | MLVF5_P26810_3mut |
| EAAAKEAAAKEAAAK | 14,521 | FFV_093209_2mut |
| EAAAKGSS | 14,522 | MLVCB_P08361_3mut |
| EAAAKGGG | 14,523 | MLVBM_Q7SVK7_3mut |
| PAPEAAAKGGG | 14,524 | FFV_093209_2mut |
| GSSGGGEAAAK | 14,525 | SFV1_P23074-Pro_2mut |
| PAPGGGEAAAK | 14,526 | GALV_P21414_3mutA |
| GGGGSGGGGSGGGGSGGGGS | 14,527 | FOAMV_P14350-Pro_2mutA |
| GSSGGG | 14,528 | FOAMV_P14350_2mut |
| GGGGSGGGGSGGGGSGGGGS | 14,529 | SFV3L_P27401_2mutA |
| GGSGSS | 14,530 | AVIRE_P03360_3mut |
| GGSGSSEAAAK | 14,531 | MMTVB_P03365_WS |
| PAPAPAP | 14,532 | MLVAV_P03356_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSGGSPAP | 14,533 | SFV3L_P27401-Pro_2mut |
| GGSPAP | 14,534 | AVIRE_P03360 |
| GGSGGGPAP | 14,535 | FFV_093209 |
| GSSEAAAK | 14,536 | PERV_Q4VFZ2 |
| GSSGGGPAP | 14,537 | PERV_Q4VFZ2_3mutA_WS |
| GGGGSSEAAAK | 14,538 | KORV_Q9TTC1_3mutA |
| GGSEAAAKPAP | 14,539 | SFVCP_Q87040 |
| GGSGGGPAP | 14,540 | FOAMV_P14350_2mutA |
| GGGGSGGGGSGGGGGGGS | 14,541 | BLVJ_P03361_2mutB |
| GGGGSSPAP | 14,542 | SFV3L_P27401_2mutA |
| EAAAKGGS | 14,543 | MLVF5_P26810_3mut |
| GGSEAAAKGSS | 14,544 | MLVCB_P08361_3mut |
| GGGGSSEAAAK | 14,545 | SFV3L_P27401_2mut |
| EAAAKGGSGGG | 14,546 | FOAMV_P14350_2mut |
| GGSGGS | 14,547 | FLV_P10273_3mut |
| EAAAKGGG | 14,548 | FFV_093209-Pro |
| GSSGSSGSSGSSGSS | 14,549 | SFV3L_P27401 |
| GSSGGGPAP | 14,550 | PERV_Q4VFZ2_3mutA_WS |
| PAPGGSEAAAK | 14,551 | SFV3L_P27401-Pro_2mutA |
| GGSPAP | 14,552 | KORV_Q9TTC1 |
| EAAAKPAPGSS | 14,553 | KORV_Q9TTC1_3mutA |
| SGSETPGTSESATPES | 14,554 | SFV1_P23074 |
| GSSPAP | 14,555 | SFV3L_P27401-Pro_2mutA |
| GSSPAPGGG | 14,556 | SFV3L_P27401_2mut |
| GGGEAAAKGSS | 14,557 | SFV1_P23074_2mut |
| GGGPAPGGS | 14,558 | BAEVM_P10272_3mut |
| EAAAKGGG | 14,559 | KORV_Q9TTC1-Pro_3mutA |
| GSSGGG | 14,560 | SFV3L_P27401-Pro_2mut |
| GGSPAPEAAAK | 14,561 | BAEVM_P10272_3mut |
| EAAAKGSSPAP | 14,562 | FFV_093209 |
| EAAAKGGGGSEAAAK | 14,563 | SFV3L_P27401-Pro_2mutA |
| GSSGSSGSSGSSGSS | 14,564 | SFV1_P23074_2mut |
| EAAAKGGSPAP | 14,565 | FOAMV_P14350_2mut |
| GGSGGS | 14,566 | KORV_Q9TTC1-Pro_3mutA |
| EAAAKGSSGGS | 14,567 | GALV_P21414 |
| GSSGGGPAP | 14,568 | MLVAV_P03356 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPEAAAKGGS | 14,569 | FOAMV_P14350_2mut |
| EAAAKPAPGGG | 14,570 | AVIRE_P03360_3mut |
| GGSPAP | 14,571 | SFV3L_P27401_2mutA |
| GGGGSGGGGS | 14,572 | SFV3L_P27401_2mutA |
| GGGGSS | 14,573 | AVIRE_P03360_3mut |
| GGSPAPGGG | 14,574 | SFV3L_P27401-Pro_2mutA |
| EAAAKPAPGSS | 14,575 | SFV3L_P27401 |
| EAAAKPAP | 14,576 | FOAMV_P14350-Pro_2mut |
| PAPEAAAKGSS | 14,577 | PERV_Q4VFZ2_3mutA_WS |
| EAAAKGGSGSS | 14,578 | SFV3L_P27401_2mutA |
| GGGEAAAKGSS | 14,579 | GALV_P21414_3mutA |
| GGGGSEAAAKGGGGS | 14,580 | PERV_Q4VFZ2_3mut |
| PAPGGSGSS | 14,581 | FFV_O93209-Pro_2mutA |
| GGSEAAAKPAP | 14,582 | GALV_P21414_3mutA |
| GGSGGSGGSGGSGGS | 14,583 | FFV_O93209-Pro |
| GSSGGSEAAAK | 14,584 | SFV3L_P27401-Pro_2mut |
| GGS | | GALV_P21414_3mutA |
| PAPGGSEAAAK | 14,586 | MLVMS_P03355 |
| PAPEAAAKGGS | 14,587 | BAEVM_P10272_3mutA |
| GGSGSSPAP | 14,588 | SFV3L_P27401-Pro_2mutA |
| GSSPAP | 14,589 | WMSV_P03359_3mut |
| GGGEAAAK | 14,590 | MMTVB_P03365 |
| GGGGSS | 14,591 | PERV_Q4VFZ2_3mut |
| GGSPAPGSS | 14,592 | SFV3L_P27401-Pro_2mut |
| PAPGGS | 14,593 | MLVBM_Q7SVK7_3mut |
| EAAAKGSSPAP | 14,594 | MLVBM_Q7SVK7_3mut |
| GGGGSSGGS | 14,595 | PERV_Q4VFZ2_3mut |
| PAPAPAPAPAPAP | 14,596 | SFV1_P23074 |
| GGSEAAAKGGG | 14,597 | SFV3L_P27401-Pro_2mut |
| GGSGGS | 14,598 | SFV1_P23074_2mut |
| GSSGGGGGS | 14,599 | MLVF5_P26810_3mutA |
| EAAAKGGGPAP | 14,600 | SFV3L_P27401 |
| EAAAKEAAAKEAAAKEAAAK | 14,601 | FOAMV_P14350-Pro_2mutA |
| GGGPAPGSS | 14,602 | SFV3L_P27401_2mutA |
| GGGGSGGGGSGGGGSGGGGS | 14,603 | SFV3L_P27401_2mut |
| EAAAKEAAAKEAAAKEAAAK | 14,604 | MMTVB_P03365_WS |
| PAPGSSGGS | 14,605 | KORV_Q9TTC1-Pro_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| PAPGSSEAAAK | 14,606 | FOAMV_P14350-Pro_2mut |
| GSSPAPEAAAK | 14,607 | BAEVM_P10272_3mut |
| EAAAKGGGSEAAAK | 14,608 | FFV_093209-Pro |
| GGSPAP | 14,609 | PERV_Q4VFZ2 |
| GGSGSSEAAAK | 14,610 | XMRV6_A1Z651_3mut |
| GGSEAAAKGGG | 14,611 | GALV_P21414_3mutA |
| PAPGGGGSS | 14,612 | AVIRE_P03360_3mutA |
| GGSGGSGGSGGS | 14,613 | PERV_Q4VFZ2 |
| GGGGSSGGS | 14,614 | PERV_Q4VFZ2_3mutA_WS |
| SGGSSGGSSGSETPGTSESATPESSGGSSGGSS | 14,615 | BAEVM_P10272_3mutA |
| GGGPAP | 14,616 | MLVAV_P03356_3mut |
| GGGGSGGGGSGGGGSGGGGS | 14,617 | FFV_093209_2mut |
| GSSEAAAK | 14,618 | FFV_093209 |
| GGSPAPEAAAK | 14,619 | FOAMV_P14350_2mut |
| GGGGGSEAAAK | 14,620 | FOAMV_P14350_2mut |
| GSSPAPGGS | 14,621 | MLVBM_Q7SVK7_3mut |
| GSS | | SFVCP_Q87040_2mut |
| EAAAKPAP | 14,623 | FOAMV_P14350-Pro |
| EAAAKGGG | 14,624 | SFV3L_P27401_2mut |
| GGGEAAAK | 14,625 | AVIRE_P03360_3mutA |
| PAPGSSGGG | 14,626 | WMSV_P03359_3mut |
| EAAAKGGSPAP | 14,627 | SFV3L_P27401 |
| GSSGGSGGG | 14,628 | SFV3L_P27401-Pro_2mutA |
| GSSGGGEAAAK | 14,629 | GALV_P21414_3mutA |
| GGGPAPGSS | 14,630 | MLVBM_Q7SVK7_3mutA_WS |
| PAPGGGEAAAK | 14,631 | FFV_093209-Pro_2mut |
| GSSGSSGSSGSS | 14,632 | SFV1_P23074_2mut |
| GGSEAAAK | 14,633 | PERV_Q4VFZ2_3mutA_WS |
| GGGEAAAKPAP | 14,634 | SFV3L_P27401_2mut |
| EAAAKGGGPAP | 14,635 | SFV3L_P27401_2mut |
| GGGGSSPAP | 14,636 | FLV_P10273_3mut |
| EAAAKPAPGSS | 14,637 | FFV_093209_2mut |
| GGGGSSPAP | 14,638 | SFV3L_P27401_2mut |
| GSSGSS | 14,639 | KORV_Q9TTC1_3mutA |
| GGGGSGGGGSGGGGSGGGGSGGGGS | 14,640 | BLVJ_P03361_2mut |
| GGGGSSGGS | 14,641 | GALV_P21414_3mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGGSGSS | 14,642 | FFV_O93209-Pro |
| EAAAKPAP | 14,643 | PERV_Q4VFZ2 |
| GSSGGGEAAAK | 14,644 | MLVBM_Q7SVK7_3mut |
| PAPGGSGGG | 14,645 | BAEVM_P10272 |
| EAAAKGGGPAP | 14,646 | MLVF5_P26810 |
| GSSGSSGSS | 14,647 | MLVBM_Q7SVK7_3mut |
| GSSGGS | 14,648 | AVIRE_P03360_3mutA |
| GGSEAAAKGGG | 14,649 | FOAMV_P14350_2mut |
| EAAAKGGS | 14,650 | MLVF5_P26810_3mutA |
| GGSGSSGGG | 14,651 | WMSV_P03359_3mut |
| EAAAK | 14,652 | SFV1_P23074_2mut |
| GSSGGSPAP | 14,653 | SFV3L_P27401-Pro_2mutA |
| GGGGSSGGS | 14,654 | KORV_Q9TTC1_3mut |
| PAPGGSGGG | 14,655 | FFV_O93209-Pro_2mut |
| GGGPAPGGS | 14,656 | SFV3L_P27401_2mutA |
| GSSPAPEAAAK | 14,657 | FLV_P10273_3mut |
| GGSGSSPAP | 14,658 | SFV3L_P27401_2mut |
| GSSEAAAKGGS | 14,659 | SFV3L_P27401_2mut |
| PAPGGG | 14,660 | SFV3L_P27401_2mutA |
| SGSETPGTSESATPES | 14,661 | KORV_Q9TTC1-Pro_3mut |
| GGGGS | 14,662 | SFV1_P23074-Pro_2mutA |
| GSSGGGEAAAK | 14,663 | WMSV_P03359 |
| EAAAKGGGGSEAAAK | 14,664 | MLVF5_P26810_3mutA |
| GSSEAAAKPAP | 14,665 | FFV_O93209 |
| GGGGGG | 14,666 | SFV1_P23074_2mutA |
| EAAAKEAAAKEAAAK | 14,667 | MMTVB_P03365-Pro |
| EAAAKPAPGSS | 14,668 | MLVBM_Q7SVK7_3mut |
| GGSGSSEAAAK | 14,669 | SFV3L_P27401_2mutA |
| GGSEAAAK | 14,670 | MLVMS_P03355_3mut |
| GGSPAPEAAAK | 14,671 | SFV3L_P27401_2mut |
| GGGPAPGSS | 14,672 | SFV1_P23074 |
| GGGGGSEAAAK | 14,673 | MLVBM_Q7SVK7_3mutA_WS |
| EAAAKPAPGSS | 14,674 | KORV_Q9TTC1-Pro |
| GSSGSSGSSGSS | 14,675 | SFV3L_P27401_2mut |
| EAAAKPAP | 14,676 | SFV3L_P27401_2mut |
| GGGEAAAK | 14,677 | PERV_Q4VFZ2_3mut |
| GGSGGS | 14,678 | SFV3L_P27401_2mutA |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| EAAAKGSSGGS | 14,679 | MMTVB_P03365 |
| SGSETPGTSESATPES | 14,680 | SFV3L_P27401 |
| EAAAKGSSGGG | 14,681 | PERV_Q4VFZ2 |
| EAAAKEAAAKEAAAKEAAAKEAAAK | 14,682 | MMTVB_P03365 |
| GGSGGGPAP | 14,683 | KORV_Q9TTC1_3mutA |
| PAPAPAPAP | 14,684 | SFV3L_P27401 |
| GGGEAAAKGGS | 14,685 | SFV1_P23074_2mut |
| GSSGGSGGG | 14,686 | PERV_Q4VFZ2_3mut |
| PAPEAAAKGGS | 14,687 | FOAMV_P14350_2mutA |
| GGGEAAAKGSS | 14,688 | SFV3L_P27401_2mut |
| GGGGSGGGGSGGGGSGGGGS | 14,689 | MLVBM_Q7SVK7 |
| PAPGSSGGG | 14,690 | FLV_P10273 |
| GGSGSSGGG | 14,691 | FFV_O93209 |
| EAAAKPAPGSS | 14,692 | MLVBM_Q7SVK7 |
| GSSEAAAKGGG | 14,693 | SFV3L_P27401_2mutA |
| GGSGGSGGSGGSGGS | 14,694 | MLVF5_P26810 |
| GGSEAAAKPAP | 14,695 | SFV3L_P27401-Pro_2mutA |
| EAAAKGGSPAP | 14,696 | SFV3L_P27401_2mutA |
| EAAAKGGGGS | 14,697 | SFV3L_P27401_2mut |
| GSSPAPEAAAK | 14,698 | SFV3L_P27401_2mutA |
| PAPAP | 14,699 | MLVBM_Q7SVK7_3mut |
| PAPGGSEAAAK | 14,700 | KORV_Q9TTC1-Pro |
| GGSGSS | 14,701 | MLVF5_P26810_3mutA |
| GGSEAAAKPAP | 14,702 | FFV_O93209_2mut |
| GSS | | MLVMS_P03355 |
| SGGSSGGSSGSETPGTSESATPESSGGSSGGSS | 14,704 | SFV3L_P27401-Pro |
| PAPGGGEAAAK | 14,705 | SFV3L_P27401_2mut |
| PAPGGGGGS | 14,706 | SFV3L_P27401-Pro_2mut |
| PAPGGSGSS | 14,707 | BAEVM_P10272_3mut |
| GSSGGGEAAAK | 14,708 | FFV_O93209 |
| GGSEAAAKPAP | 14,709 | SFV1_P23074_2mut |
| GGGGG | 14,710 | FLV_P10273_3mut |
| GGGEAAAKGSS | 14,711 | SFV3L_P27401 |
| GSSGSSGSSGSSGSS | 14,712 | SFV1_P23074-Pro |
| SGSETPGTSESATPES | 14,713 | AVIRE_P03360 |
| PAPGSSGGG | 14,714 | MLVBM_Q7SVK7_3mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSSPAP | 14,715 | HTL3P_Q4U0X6_2mut |
| GGGEAAAK | 14,716 | SFV1_P23074 |
| GGSGGG | 14,717 | AVIRE_P03360 |
| EAAAKGSSGGG | 14,718 | SFV3L_P27401_2mutA |
| GSSPAPEAAAK | 14,719 | FOAMV_P14350-Pro_2mutA |
| GGGPAPGSS | 14,720 | WMSV_P03359 |
| EAAAKGSSGGG | 14,721 | MLVMS_P03355 |
| GGGGGSEAAAK | 14,722 | MLVMS_P03355 |
| EAAAKPAPGGS | 14,723 | SFV3L_P27401 |
| EAAAKGSSPAP | 14,724 | SFV3L_P27401 |
| GGGGGGG | 14,725 | FOAMV_P14350_2mutA |
| EAAAKEAAAKEAAAK | 14,726 | SFV3L_P27401 |
| GSSPAPGGS | 14,727 | FFV_O93209_2mutA |
| GGGGSSEAAAK | 14,728 | SFV3L_P27401-Pro_2mutA |
| GGSEAAAKGSS | 14,729 | GALV_P21414_3mutA |
| GGSEAAAKGSS | 14,730 | BAEVM_P10272_3mutA |
| EAAAKPAPGGG | 14,731 | MLVCB_P08361 |
| GSSGSSGSSGSSGSSGSS | 14,732 | SFV1_P23074-Pro |
| GGGGSEAAAKGGGGS | 14,733 | FOAMV_P14350_2mut |
| GSSPAPGGS | 14,734 | MLVMS_P03355_PLV919 |
| GGGGSGGGGS | 14,735 | FFV_O93209-Pro |
| GSSGGSPAP | 14,736 | KORV_Q9TTC1_3mutA |
| GGSGGS | 14,737 | GALV_P21414_3mutA |
| PAPGSSEAAAK | 14,738 | WMSV_P03359 |
| PAPGGGGSS | 14,739 | MMTVB_P03365-Pro |
| GGGGSSGGS | 14,740 | PERV_Q4VFZ2_3mutA_WS |
| GGGGSGGGGS | 14,741 | FFV_O93209_2mut |
| GGGGSGGGGSGGGGSGGGGS | 14,742 | XMRV6_A1Z651 |
| GGSGSSEAAAK | 14,743 | SFV1_P23074_2mut |
| GGSGGGGSS | 14,744 | GALV_P21414_3mutA |
| GGSEAAAKPAP | 14,745 | MLVBM_Q7SVK7 |
| EAAAKGGSPAP | 14,746 | SFV1_P23074_2mutA |
| PAPAPAPAP | 14,747 | FFV_O93209 |
| GSSGGSPAP | 14,748 | MMTVB_P03365-Pro |
| GGGGGSPAP | 14,749 | KORV_Q9TTC1_3mutA |
| EAAAKGGGPAP | 14,750 | PERV_Q4VFZ2 |
| GSSGGSPAP | 14,751 | BAEVM_P10272 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGG | 14,752 | FFV_093209 |
| GGGGGS | 14,753 | FLV_P10273_3mutA |
| EAAAKEAAAKEAAAK | 14,754 | FOAMV_P14350 |
| PAPGGG | 14,755 | MLVCB_P08361_3mut |
| GSSGGSEAAAK | 14,756 | FOAMV_P14350_2mutA |
| GGSPAPGGG | 14,757 | FLV_P10273_3mut |
| GSSGSSGSSGSSGSSGSS | 14,758 | SFV1_P23074-Pro_2mutA |
| GGSPAPEAAAK | 14,759 | SFV3L_P27401 |
| PAPGGGGSS | 14,760 | HTL3P_Q4U0X6_2mutB |
| GGGGSSEAAAK | 14,761 | MMTVB_P03365_2mut_WS |
| PAPGGS | 14,762 | MLVRD_P11227_3mut |
| GGSGGSGGSGGSGGS | 14,763 | MMTVB_P03365 |
| GSAGSAAGSGEF | 14,764 | AVIRE_P03360 |
| GSSGGS | 14,765 | BAEVM_P10272_3mutA |
| GGSGGGGSS | 14,766 | MMTVB_P03365 |
| GGSGGGGSS | 14,767 | WMSV_P03359 |
| PAPEAAAKGSS | 14,768 | SFV1_P23074 |
| GSSGSSGSSGSS | 14,769 | SFV1_P23074-Pro_2mutA |
| PAPAPAPAPAPAP | 14,770 | SFV3L_P27401 |
| PAPGSSGGG | 14,771 | FLV_P10273_3mut |
| GGSGSSPAP | 14,772 | MLVMS_P03355 |
| GGSGGGPAP | 14,773 | FOAMV_P14350 |
| PAPGGGGGS | 14,774 | KORV_Q9TTC1_3mutA |
| EAAAKGSSPAP | 14,775 | GALV_P21414_3mutA |
| GGSGSSPAP | 14,776 | MLVBM_Q7SVK7_3mut |
| EAAAKGSS | 14,777 | SFV3L_P27401_2mut |
| GGGGGSEAAAK | 14,778 | WMSV_P03359 |
| GGGGGGGG | 14,779 | SFV1_P23074-Pro |
| EAAAKEAAAK | 14,780 | MLVBM_Q7SVK7 |
| GGGEAAAKGGS | 14,781 | MLVBM_Q7SVK7 |
| EAAAKGGSPAP | 14,782 | SFV3L_P27401_2mut |
| GSSEAAAK | 14,783 | XMRV6_A1Z651 |
| PAPGGGEAAAK | 14,784 | MMTVB_P03365_WS |
| GGSPAP | 14,785 | GALV_P21414_3mutA |
| GSSPAPGGG | 14,786 | MLVBM_Q7SVK7_3mutA_WS |
| GGSGSSPAP | 14,787 | SFV1_P23074_2mutA |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGS | | HTL32_QOR5R2_2mut |
| GGSGGGGSS | 14,789 | MMTVB_P03365-Pro |
| GGGGSGGGGSGGGGSGGGGS | 14,790 | SFVCP_Q87040_2mutA |
| EAAAKGGGPAP | 14,791 | FOAMV_P14350_2mut |
| GSSGGGEAAAK | 14,792 | MMTVB_P03365 |
| SGGSSGGSSGSETPGTSESATPESSGGSSGGSS | 14,793 | MLVBM_Q7SVK7_3mutA_WS |
| AEAAAKEAAAKEAAAKEAAAKALEAEAAAKEAAAKEAAAKEAAAKA | 14,794 | MMTVB_P03365_WS |
| EAAAKEAAAK | 14,795 | FOAMV_P14350-Pro_2mut |
| GSSPAPEAAAK | 14,796 | FOAMV_P14350_2mutA |
| EAAAKPAPGGS | 14,797 | GALV_P21414_3mutA |
| GSSGGSPAP | 14,798 | KORV_Q9TTC1-Pro_3mut |
| GGGPAPEAAAK | 14,799 | MLVAV_P03356 |
| GGGEAAAKPAP | 14,800 | SFV1_P23074-Pro_2mut |
| GGGGGSEAAAK | 14,801 | SFV3L_P27401_2mut |
| GGGPAPGSS | 14,802 | SFV3L_P27401_2mut |
| GGSEAAAKPAP | 14,803 | AVIRE_P03360 |
| GSSGSSGSSGSSGSSGSS | 14,804 | SFV1_P23074-Pro_2mut |
| EAAAKGSSGGS | 14,805 | FOAMV_P14350_2mutA |
| GGGGGG | 14,806 | MLVBM_Q7SVK7_3mut |
| GSSPAPGGS | 14,807 | PERV_Q4VFZ2 |
| GGSGSSPAP | 14,808 | GALV_P21414_3mutA |
| GGGPAPEAAAK | 14,809 | SFV3L_P27401 |
| GGSGGGEAAAK | 14,810 | WMSV_P03359 |
| GSAGSAAGSGEF | 14,811 | SFV1_P23074_2mut |
| GSSGGGEAAAK | 14,812 | MLVMS_P03355 |
| GGG | | MMTVB_P03365-Pro |
| PAPGSSGGS | 14,814 | FOAMV_P14350_2mut |
| GGGGSSPAP | 14,815 | FFV_093209_2mut |
| SGGSSGGSSGSETPGTSESATPESSGGSSGGSS | 14,816 | MMTVB_P03365_WS |
| GGGGGGG | 14,817 | XMRV6_A1Z651 |
| PAPAPAPAPAP | 14,818 | FOAMV_P14350 |
| GGGGSGGGGSGGGGSGGGGS | 14,819 | MMTVB_P03365_2mut_WS |
| GGSGGGPAP | 14,820 | SFV3L_P27401_2mut |
| GGGGGG | 14,821 | SFV1_P23074-Pro |
| EAAAKPAPGSS | 14,822 | SFV3L_P27401_2mut |
| GGGGSSGGS | 14,823 | HTL3P_Q4U0X6_2mut |
| PAPGSSEAAAK | 14,824 | MMTVB_P03365-Pro |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSSPAP | 14,825 | FOAMV_P14350-Pro_2mut |
| PAPGSSGGS | 14,826 | MMTVB_P03365 |
| AEAAAKEAAAKEAAAKEAAAKALEAEAAAKEAAAKEAAAKEAAAKA | 14,827 | SRV2_P51517 |
| PAPAPAP | 14,828 | MMTVB_P03365_2mut_WS |
| PAPGGGGGS | 14,829 | MMTVB_P03365_2mutB |
| GGGGSS | 14,830 | SFV1_P23074-Pro_2mutA |
| EAAAKEAAAKEAAAKEAAAK | 14,831 | SFV3L_P27401-Pro |
| GGSGGSGGSGGSGGS | 14,832 | MMTVB_P03365-Pro |
| GGGGGGG | 14,833 | SFV3L_P27401_2mut |
| PAPGGGEAAAK | 14,834 | SFV3L_P27401 |
| PAPGSS | 14,835 | FOAMV_P14350_2mutA |
| GGGGSGGGGS | 14,836 | SFVCP_Q87040_2mutA |
| GSSGGSGGG | 14,837 | XMRV6_A1Z651 |
| GGGGSGGGGSGGGGGGGSGGGGSGGGGS | 14,838 | MLVBM_Q7SVK7 |
| GSSEAAAKGGG | 14,839 | FFV_093209-Pro_2mut |
| GGSEAAAKPAP | 14,840 | SFV3L_P27401-Pro |
| GSSGGSGGG | 14,841 | SFV1_P23074_2mut |
| EAAAKGGGGSS | 14,842 | FOAMV_P14350_2mutA |
| GGGGGG | 14,843 | SFV3L_P27401_2mut |
| GGGGG | 14,844 | MLVBM_Q7SVK7_3mut |
| PAPEAAAKGGG | 14,845 | SFV3L_P27401 |
| EAAAKGGSPAP | 14,846 | KORV_Q9TTC1_3mutA |
| GGGEAAAKPAP | 14,847 | SFV1_P23074_2mut |
| GSSGSSGSSGSSGSSGSS | 14,848 | KORV_Q9TTC1-Pro |
| EAAAKEAAAKEAAAKEAAAK | 14,849 | SFVCP_Q87040 |
| PAPGSSEAAAK | 14,850 | MLVBM_Q7SVK7 |
| GSSGSSGSS | 14,851 | FFV_093209-Pro_2mut |
| GSSGGGPAP | 14,852 | SFV3L_P27401-Pro_2mut |
| GGGPAPEAAAK | 14,853 | WMSV_P03359_3mut |
| GGGEAAAK | 14,854 | MMTVB_P03365-Pro |
| GSSGSSGSSGSS | 14,855 | SFV3L_P27401-Pro_2mutA |
| PAPAPAPAPAP | 14,856 | FFV_093209-Pro |
| GGSPAPEAAAK | 14,857 | FFV_093209-Pro_2mut |
| GSSGSSGSSGSSGSSGSS | 14,858 | GALV_P21414 |
| EAAAKEAAAKEAAAKEAAAKEAAAK | 14,859 | FOAMV_P14350 |
| GGGPAPEAAAK | 14,860 | MMTVB_P03365-Pro |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| PAPGGSGGG | 14,861 | MLVF5_P26810_3mutA |
| PAPGGSGGG | 14,862 | FLV_P10273_3mut |
| GGGEAAAKGGS | 14,863 | SFV3L_P27401 |
| GSAGSAAGSGEF | 14,864 | MLVBM_Q7SVK7_3mut |
| GSSPAPGGG | 14,865 | MPMV_P07572_2mutB |
| GSSGSSGSSGSSGSSGSS | 14,866 | FOAMV_P14350 |
| GGSGGGGSS | 14,867 | BLVJ_P03361_2mut |
| PAPEAAAKGSS | 14,868 | SFV1_P23074-Pro |
| GGG | | FFV_093209 |
| EAAAKGGGGSS | 14,870 | SFV1_P23074_2mut |
| EAAAKEAAAKEAAAKEAAAKEAAAKEAAAK | 14,871 | SRV2_P51517 |
| GGGGSGGGGSGGGGSGGGGSGGGGSGGGGS | 14,872 | MMTVB_P03365 |
| GGGEAAAKGGS | 14,873 | MMTVB_P03365_WS |
| GSSGSS | 14,874 | SFV1_P23074 |
| GSSGGGGGS | 14,875 | SFV3L_P27401 |
| GGGGSSEAAAK | 14,876 | SFV1_P23074 |
| EAAAKGSSGGS | 14,877 | HTL1A_P03362_2mutB |
| GSSEAAAKGGS | 14,878 | GALV_P21414_3mutA |
| EAAAKGSSPAP | 14,879 | SFV1_P23074 |
| EAAAKPAPGSS | 14,880 | SFV3L_P27401_2mutA |
| PAPGSSGGG | 14,881 | SFV3L_P27401-Pro_2mut |
| GGGGSGGGGSGGGGSGGGGSGGGGSGGGGS | 14,882 | SFV3L_P27401-Pro |
| EAAAKEAAAKEAAAKEAAAKEAAAK | 14,883 | MMTVB_P03365_WS |
| GGGGSSEAAAK | 14,884 | MLVF5_P26810_3mutA |
| EAAAKGGSPAP | 14,885 | GALV_P21414 |
| PAPEAAAKGSS | 14,886 | MMTVB_P03365_WS |
| GSSGGGGGS | 14,887 | SFVCP_Q87040_2mut |
| GGGGSSPAP | 14,888 | SFV1_P23074 |
| EAAAKGGGGSS | 14,889 | XMRV6_A1Z651 |
| PAPAPAPAP | 14,890 | MMTVB_P03365 |
| GGSEAAAKGSS | 14,891 | SFV3L_P27401_2mutA |
| GSSPAPGGG | 14,892 | MMTVB_P03365_WS |
| GGGGGG | 14,893 | SFV3L_P27401-Pro |
| GGSGGSGGS | 14,894 | FOAMV_P14350-Pro_2mut |
| PAPAPAPAPAPAP | 14,895 | WMSV_P03359 |
| GSSPAP | 14,896 | MLVBM_Q7SVK7 |
| GGGGGSGSS | 14,897 | MMTVB_P03365_2mut_WS |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| EAAAKGSSGGS | 14,898 | MMTVB_P03365_2mutB_WS |
| EAAAK | 14,899 | FFV_093209_2mutA |
| PAPEAAAK | 14,900 | SFV1_P23074-Pro |
| EAAAKGGSGSS | 14,901 | SFV3L_P27401 |
| GGSGGSGGS | 14,902 | FFV_093209-Pro |
| GSSGGGEAAAK | 14,903 | MMTVB_P03365 |
| SGGSSGGSSGSETPGTSESATPESSGGSSGGSS | 14,904 | MLVFF_P26809_3mutA |
| GGSGGSGGSGGSGGSGGS | 14,905 | HTL1L_POC211_2mutB |
| GGGEAAAK | 14,906 | SFV3L_P27401-Pro_2mutA |
| GGGGGSGSS | 14,907 | MMTVB_P03365 |
| GSSPAPGGS | 14,908 | FOAMV_P14350_2mutA |
| EAAAKGSS | 14,909 | MLVMS_P03355 |
| GSSGGSGGG | 14,910 | FFV_093209-Pro |
| GGSGGGGSS | 14,911 | MMTVB_P03365-Pro_2mut |
| GGSPAPGSS | 14,912 | FOAMV_P14350_2mut |
| GGSGGSGGSGGSGGSGGS | 14,913 | SFVCP_Q87040-Pro_2mut |
| GSSEAAAKGGG | 14,914 | FOAMV_P14350_2mutA |
| GGSGGSGGS | 14,915 | MMTVB_P03365-Pro |
| GSSGSSGSSGSSGSSGSS | 14,916 | MMTVB_P03365_2mut_WS |
| GSSGSSGSSGSSGSS | 14,917 | MMTVB_P03365-Pro |
| PAPEAAAK | 14,918 | WDSV_092815 |
| GSSGSSGSSGSSGSS | 14,919 | FFV_093209-Pro_2mut |
| EAAAKGGGGSEAAAK | 14,920 | MMTVB_P03365-Pro |
| GGSPAPEAAAK | 14,921 | FOAMV_P14350 |
| GSSGSS | 14,922 | PERV_Q4VFZ2 |
| GGG | | MMTVB_P03365-Pro |
| GGGGSGGGGSGGGGS | 14,924 | FFV_093209_2mut |
| EAAAKEAAAKEAAAKEAAAKEAAAK | 14,925 | MMTVB_P03365-Pro |
| GGSGSSPAP | 14,926 | WMSV_P03359 |
| GGGGGGGG | 14,927 | SFV3L_P27401_2mut |
| PAPGSSEAAAK | 14,928 | FOAMV_P14350-Pro_2mutA |
| GGGGSSPAP | 14,929 | FOAMV_P14350_2mut |
| GSSGGSPAP | 14,930 | MLVBM_Q7SVK7_3mut |
| GSSGGGGGS | 14,931 | GALV_P21414_3mutA |
| EAAAKEAAAKEAAAKEAAAK | 14,932 | MMTVB_P03365 |
| GSSGGGGGS | 14,933 | SFV1_P23074_2mut |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGGGSEAAAKGGGGS | 14,934 | SFV1_P23074 |
| GGGEAAAKPAP | 14,935 | FFV_093209 |
| PAPGGGEAAAK | 14,936 | SFV1_P23074 |
| GGSGGGEAAAK | 14,937 | PERV_Q4VFZ2_3mutA_WS |
| GSSGGG | 14,938 | MMTVB_P03365-Pro |
| EAAAKGSSGGS | 14,939 | FFV_093209_2mut |
| GGGGG | 14,940 | SFV1_P23074_2mut |
| GGGPAP | 14,941 | SFV3L_P27401 |
| GSSGGSEAAAK | 14,942 | FFV_093209 |
| SGGSSGGSSGSETPGTSESATPESSGGSSGGSS | 14,943 | MMTVB_P03365-Pro |
| GSSGGGEAAAK | 14,944 | SFV1_P23074_2mutA |
| GSSGSSGSSGSSGSS | 14,945 | SFV3L_P27401_2mut |
| GGSEAAAKPAP | 14,946 | FLV_P10273 |
| GGGGSGGGGS | 14,947 | FOAMV_P14350-Pro_2mutA |
| GSSEAAAKPAP | 14,948 | SFV3L_P27401 |
| GGGGSEAAAKGGGGS | 14,949 | MMTVB_P03365-Pro |
| PAPGSSEAAAK | 14,950 | MLVF5_P26810_3mut |
| EAAAKGGSGGG | 14,951 | SFV3L_P27401 |
| GGGPAPGGS | 14,952 | SFV3L_P27401 |
| GSSEAAAKGGS | 14,953 | FOAMV_P14350_2mutA |
| EAAAKGGSGGG | 14,954 | HTL1L_POC211 |
| GSSGGSPAP | 14,955 | SFV3L_P27401_2mutA |
| PAPAP | 14,956 | FFV_093209 |
| PAPGGSGSS | 14,957 | MMTVB_P03365_WS |
| EAAAKGGGGS | 14,958 | FOAMV_P14350_2mut |
| PAPEAAAKGGS | 14,959 | SFV3L_P27401_2mut |
| GSSEAAAKPAP | 14,960 | MMTVB_P03365-Pro |
| GGSGGS | 14,961 | PERV_Q4VFZ2_3mut |
| GSSEAAAKGGG | 14,962 | FFV_093209-Pro_2mutA |
| EAAAK | 14,963 | HTL1L_POC211 |
| GSSPAP | 14,964 | MLVMS_P03355 |
| EAAAKPAPGGG | 14,965 | FFV_093209-Pro_2mut |
| GGGGSEAAAKGGGGS | 14,966 | SFV1_P23074-Pro_2mut |
| EAAAKGSSGGS | 14,967 | SFV3L_P27401 |
| GSAGSAAGSGEF | 14,968 | FFV_093209_2mutA |
| PAPEAAAKGGS | 14,969 | MMTVB_P03365_2mutB_WS |
| EAAAKEAAAKEAAAKEAAAKEAAAKEAAAK | 14,970 | MMTVB_P03365 |

TABLE 1-continued

Combinations of linker and RT sequences screened. The amino acid sequence of each RT in this table is provided in Table 6.

| Linker amino acid sequence | SEQ ID NO: of Linker | RT domain name |
| --- | --- | --- |
| GGS | | MMTVB_P03365 |
| GGSEAAAKPAP | 14,972 | SFV1_P23074 |
| EAAAKGSSGGG | 14,973 | HTLV2_P03363_2mut |
| GGSEAAAKGGG | 14,974 | MMTVB_P03365_WS |
| GGSGGS | 14,975 | FFV_093209-Pro |
| GSSEAAAKGGS | 14,976 | MMTVB_P03365-Pro |
| PAPAPAPAPAP | 14,977 | SFV1_P23074_2mutA |
| GGSEAAAKGGG | 14,978 | MMTVB_P03365_2mutB_WS |
| PAPAPAPAP | 14,979 | MMTVB_P03365_WS |
| GGGGSGGGGSGGGGSGGGGSGGGGS | 14,980 | HTL3P_Q4U0X6_2mut |
| PAPGGSEAAAK | 14,981 | SFV1_P23074-Pro_2mut |
| GGSGGGPAP | 14,982 | MMTVB_P03365 |
| GSSGSSGSSGSSGSSGSS | 14,983 | MMTVB_P03365-Pro |
| GGSEAAAKPAP | 14,984 | SFV1_P23074-Pro |
| GGGEAAAKGSS | 14,985 | SFV3L_P27401_2mutA |
| GGGPAPGGS | 14,986 | AVIRE_P03360 |
| PAPGGG | 14,987 | MLVRD_P11227 |
| GGSEAAAKGSS | 14,988 | SFV3L_P27401_2mut |
| GGGEAAAKGSS | 14,989 | FOAMV_P14350_2mut |
| GGGEAAAKGSS | 14,990 | SFV1_P23074-Pro |
| EAAAKEAAAKEAAAKEAAAK | 14,991 | MLVAV_P03356 |
| EAAAKGGGPAP | 14,992 | JSRV_P31623_2mutB |
| EAAAKGGGGSS | 14,993 | FOAMV_P14350_2mut |
| EAAAKEAAAKEAAAKEAAAKEAAAK | 14,994 | SRV2_P51517 |
| GSSGGGGGS | 14,995 | FFV_093209 |
| PAPAPAP | 14,996 | FOAMV_P14350_2mutA |
| GGSGGSGGSGGS | 14,997 | FOAMV_P14350 |
| GGGEAAAK | 14,998 | MMTVB_P03365_WS |
| GGGGGS | 14,999 | SFV1_P23074_2mutA |
| GGSGGS | 15,000 | WMSV_P03359_3mut |
| EAAAKGGS | 15,001 | MMTVB_P03365-Pro |
| GGGGSS | 15,002 | BLVJ_P03361_2mut |
| PAPAP | 15,003 | MMTVB_P03365-Pro_2mut |
| PAPGGG | 15,004 | SMRVH_P03364 |
| EAAAKGGGGSS | 15,005 | SFV3L_P27401 |
| PAPAPAPAPAP | 15,006 | MMTVB_P03365 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGPAP | 15,007 | MMTVB_P03365-Pro |
| GSSGGSGGG | 15,008 | MMTVB_P03365 |
| EAAAKGGGPAP | 15,009 | FOAMV_P14350_2mutA |
| GSSGSSGSSGSS | 15,010 | SFV1_P23074 |
| GGGGSGGGGS | 15,011 | SFV3L_P27401 |
| GSSGGSGGG | 15,012 | MLVF5_P26810 |
| GGGEAAAKPAP | 15,013 | MMTVB_P03365-Pro |
| PAPEAAAK | 15,014 | HTLV2_P03363_2mut |
| GSSGSSGSSGSS | 15,015 | FOAMV_P14350_2mut |
| GSSEAAAKPAP | 15,016 | MMTVB_P03365-Pro |
| PAPEAAAKGGG | 15,017 | HTL3P_Q4U0X6_2mut |
| GGSEAAAKGSS | 15,018 | MMTVB_P03365-Pro |
| EAAAKPAPGGS | 15,019 | MMTVB_P03365_2mut_WS |
| GSSGGSEAAAK | 15,020 | MLVF5_P26810_3mutA |
| GGGGSGGGGSGGGGSGGGGSGGGGSGGGGS | 15,021 | MLVF5_P26810_3mut |
| EAAAKGGGGSS | 15,022 | MMTVB_P03365-Pro |
| GGGGGSGSS | 15,023 | HTL1A_P03362_2mutB |
| PAPAP | 15,024 | FFV_093209-Pro_2mut |
| GGGGGSPAP | 15,025 | HTL1C_P14078_2mut |
| GGGPAP | 15,026 | HTLV2_P03363_2mut |
| EAAAKGGGGSEAAAK | 15,027 | SFVCP_Q87040 |
| GGSEAAAKGGG | 15,028 | FFV_093209-Pro_2mutA |
| GSSPAPGGS | 15,029 | FOAMV_P14350-Pro_2mut |
| GGGGGGG | 15,030 | MMTVB_P03365-Pro |
| EAAAKGSS | 15,031 | SFV3L_P27401_2mutA |
| EAAAKGGGGSEAAAK | 15,032 | MMTVB_P03365-Pro |
| GGGGSEAAAKGGGGS | 15,033 | SFV1_P23074-Pro_2mutA |
| EAAAKGGGGSS | 15,034 | MMTVB_P03365 |
| GGGEAAAKGGS | 15,035 | SFV1_P23074 |
| PAPEAAAKGGG | 15,036 | MLVF5_P26810 |
| GGGGSSGGS | 15,037 | MMTVB_P03365 |
| GGSGSS | 15,038 | MMTVB_P03365 |
| PAPAPAPAPAPAP | 15,039 | KORV_Q9TTC1 |
| EAAAKGGG | 15,040 | SFV1_P23074-Pro_2mut |
| PAPAPAPAPAPAP | 15,041 | SRV2_P51517 |
| GSSGSSGSSGSSGSS | 15,042 | FFV_093209-Pro_2mutA |
| GGGGSS | 15,043 | FOAMV_P14350_2mut |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPGGGEAAAK | 15,044 | MMTVB_P03365_WS |
| GGSGGGEAAAK | 15,045 | FFV_093209-Pro_2mut |
| PAPAPAPAPAP | 15,046 | MMTVB_P03365_WS |
| GGGEAAAKGGS | 15,047 | MMTVB_P03365-Pro |
| GGGEAAAKGSS | 15,048 | MMTVB_P03365_2mutB |
| GSSPAPEAAAK | 15,049 | MMTVB_P03365_WS |
| EAAAKEAAAKEAAAKEAAAKEAAAK | 15,050 | SFV1_P23074-Pro_2mutA |
| PAPGGG | 15,051 | SFV3L_P27401 |
| GSSEAAAKGGG | 15,052 | MMTVB_P03365_WS |
| GGGGSSEAAAK | 15,053 | FOAMV_P14350_2mut |
| PAPGSSGGS | 15,054 | SFV1_P23074-Pro_2mut |
| GSSGSSGSSGSSGSSGSS | 15,055 | SFV3L_P27401 |
| EAAAKGSSGGG | 15,056 | MMTVB_P03365 |
| PAPGGGGSS | 15,057 | WDSV_092815_2mutA |
| GGSPAP | 15,058 | MMTVB_P03365-Pro |
| GGSGGSGGSGGSGGS | 15,059 | SFVCP_Q87040-Pro_2mut |
| PAPAPAPAP | 15,060 | MMTVB_P03365-Pro |
| GGGGG | 15,061 | HTL1A_P03362 |
| GGSGGSGGSGGS | 15,062 | SFV1_P23074_2mutA |
| GSSGSSGSSGSSGSS | 15,063 | FOAMV_P14350-Pro_2mut |
| PAPGGSEAAAK | 15,064 | MMTVB_P03365_2mutB_WS |
| PAPAPAPAP | 15,065 | SFV1_P23074_2mut |
| PAPGGGGSS | 15,066 | MMTVB_P03365 |
| GGSGSS | 15,067 | SFV3L_P27401_2mut |
| EAAAKEAAAKEAAAKEAAAK | 15,068 | MMTVB_P03365_2mut |
| EAAAKGGSGGG | 15,069 | HTL3P_Q4U0X6_2mut |
| PAPGGGGSS | 15,070 | SFVCP_Q87040-Pro_2mutA |
| EAAAKGGGGGS | 15,071 | MLVAV_P03356 |
| GGGGGS | 15,072 | FOAMV_P14350_2mut |
| GGGEAAAKGGS | 15,073 | FFV_093209-Pro_2mutA |
| EAAAKPAPGGG | 15,074 | MMTVB_P03365_2mutB |
| GGSGGGPAP | 15,075 | FFV_093209_2mut |
| GSSEAAAKPAP | 15,076 | MMTVB_P03365 |
| PAPAPAPAPAPAP | 15,077 | SFV1_P23074_2mut |
| GGSPAPGGG | 15,078 | MMTVB_P03365-Pro |
| GGSGGGEAAAK | 15,079 | MMTVB_P03365 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| PAPAP | 15,080 | SFVCP_Q87040 |
| GSSEAAAK | 15,081 | SFVCP_Q87040 |
| GGGGSGGGGSGGGGS | 15,082 | MMTVB_P03365-Pro |
| GSSGSSGSS | 15,083 | SFV3L_P27401 |
| EAAAKGGSGGG | 15,084 | MMTVB_P03365-Pro |
| GSSPAP | 15,085 | SFV1_P23074_2mut |
| GGGEAAAK | 15,086 | SFV1_P23074-Pro |
| AEAAAKEAAAKEAAAKEAAAKALEAEAAAKEAAAKEAAAKEAAAKA | 15,087 | MMTVB_P03365-Pro |
| PAPGGS | 15,088 | HTL1C_P14078_2mut |
| PAPGSSGGS | 15,089 | SFV1_P23074_2mut |
| PAPEAAAK | 15,090 | MMTVB_P03365_WS |
| PAPAP | 15,091 | MMTVB_P03365-Pro |
| EAAAKGGS | 15,092 | HTL1A_P03362_2mut |
| GGGGSEAAAKGGGGS | 15,093 | HTL1C_P14078 |
| EAAAKGSSGGS | 15,094 | FOAMV_P14350-Pro |
| PAPGGSGSS | 15,095 | MMTVB_P03365-Pro |
| PAPGGSEAAAK | 15,096 | SFV1_P23074_2mut |
| PAPGSSEAAAK | 15,097 | FFV_093209-Pro_2mut |
| PAPGSSGGG | 15,098 | FOAMV_P14350-Pro_2mutA |
| GSSGGGEAAAK | 15,099 | AVIRE_P03360 |
| GGGGGG | 15,100 | SMRVH_P03364_2mut |
| PAPEAAAKGGG | 15,101 | MMTVB_P03365-Pro |
| GGGEAAAKGGS | 15,102 | SFVCP_Q87040_2mutA |
| PAPAPAPAPAP | 15,103 | SRV2_P51517 |
| GSSGSSGSSGSSGSSGSS | 15,104 | MMTVB_P03365 |
| EAAAKGGGPAP | 15,105 | MLVAV_P03356 |
| PAPAPAPAPAP | 15,106 | FOAMV_P14350-Pro_2mutA |
| PAPGGSEAAAK | 15,107 | FOAMV_P14350 |
| GSSGGGPAP | 15,108 | HTL32_Q0R5R2_2mutB |
| GGGGGSPAP | 15,109 | HTL3P_Q4U0X6_2mutB |
| GSSGGSGGG | 15,110 | MMTVB_P03365-Pro |
| PAPAP | 15,111 | SFVCP_Q87040-Pro |
| GSSGGGPAP | 15,112 | MMTVB_P03365-Pro |
| GGSGSS | 15,113 | MMTVB_P03365-Pro_2mut |
| GGSPAPEAAAK | 15,114 | SFV1_P23074-Pro_2mut |
| EAAAKGGSGGG | 15,115 | SFV3L_P27401_2mut |
| GGGGSSEAAAK | 15,116 | MMTVB_P03365_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGGSGSS | 15,117 | MMTVB_P03365_2mut |
| GGGGSSGGS | 15,118 | SFV1_P23074-Pro_2mutA |
| EAAAKGGGGSEAAAK | 15,119 | MMTVB_P03365_WS |
| PAPGGGEAAAK | 15,120 | SFV1_P23074-Pro |
| PAPEAAAKGGG | 15,121 | MMTVB_P03365 |
| AEAAAKEAAAKEAAAKEAAAKALEAEAAAKEAAAKEAAAKEAAAKA | 15,122 | MMTVB_P03365 |
| GSSGGSEAAAK | 15,123 | FOAMV_P14350-Pro_2mut |
| GGSPAP | 15,124 | MLVBM_Q7SVK7_3mut |
| GSSEAAAK | 15,125 | FOAMV_P14350 |
| GSSEAAAK | 15,126 | MMTVB_P03365-Pro |
| EAAAKGSSGGS | 15,127 | HTL1A_P03362_2mut |
| GGGEAAAKPAP | 15,128 | FOAMV_P14350-Pro_2mut |
| EAAAKGGSPAP | 15,129 | FOAMV_P14350 |
| GSSEAAAKPAP | 15,130 | MMTVB_P03365_WS |
| GSSGSSGSS | 15,131 | FOAMV_P14350_2mut |
| EAAAKEAAAKEAAAKEAAAK | 15,132 | MMTVB_P03365_WS |
| EAAAK | 15,133 | MMTVB_P03365 |
| PAPGSS | 15,134 | BAEVM_P10272 |
| PAPGGS | 15,135 | FFV_093209-Pro_2mut |
| GGSGGS | 15,136 | SFV1_P23074-Pro_2mutA |
| SGGSSGGSSGSETPGTSESATPESSGGSSGGSS | 15,137 | HTLV2_P03363_2mut |
| GGSGGGEAAAK | 15,138 | MMTVB_P03365_WS |
| PAPGSSGGG | 15,139 | HTL1A_P03362 |
| GGSGGS | 15,140 | SFV3L_P27401-Pro |
| GSSGSS | 15,141 | SFV1_P23074-Pro |
| PAPGGSEAAAK | 15,142 | MMTVB_P03365 |
| GSAGSAAGSGEF | 15,143 | MMTVB_P03365-Pro |
| PAPGGG | 15,144 | FOAMV_P14350_2mut |
| EAAAKGGSGSS | 15,145 | MMTVB_P03365_WS |
| GSSGGGEAAAK | 15,146 | SFV3L_P27401-Pro |
| GGSGGGPAP | 15,147 | FOAMV_P14350-Pro_2mut |
| PAPAPAPAPAPAP | 15,148 | WDSV_092815 |
| SGSETPGTSESATPES | 15,149 | SFVCP_Q87040-Pro_2mutA |
| GGSGGSGGS | 15,150 | SFV1_P23074 |
| GGGGSS | 15,151 | SFVCP_Q87040_2mut |
| GGGGGSEAAAK | 15,152 | MMTVB_P03365 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| SGSETPGTSESATPES | 15,153 | MMTVB_P03365_WS |
| PAPAPAP | 15,154 | SFV3L_P27401 |
| PAPEAAAKGSS | 15,155 | MMTVB_P03365_2mutB_WS |
| GSSGSSGSSGSSGSS | 15,156 | SRV2_P51517 |
| GGGPAPGSS | 15,157 | HTL32_QOR5R2_2mutB |
| GGSGGGGSS | 15,158 | MMTVB_P03365-Pro |
| SGSETPGTSESATPES | 15,159 | SRV2_P51517 |
| EAAAKGSSGGS | 15,160 | MMTVB_P03365-Pro |
| GSSPAPEAAAK | 15,161 | MMTVB_P03365-Pro |
| GSSPAPEAAAK | 15,162 | SRV2_P51517 |
| GGGGSSPAP | 15,163 | MMTVB_P03365-Pro |
| PAPGGGEAAAK | 15,164 | SFV1_P23074-Pro_2mutA |
| PAPEAAAKGGS | 15,165 | MMTVB_P03365 |
| GSSGSSGSSGSSGSSGSS | 15,166 | FOAMV_P14350-Pro |
| GGSPAPGSS | 15,167 | SFV3L_P27401 |
| GGGPAPGGS | 15,168 | SFV1_P23074-Pro_2mutA |
| GGGPAPGSS | 15,169 | MMTVB_P03365-Pro |
| EAAAKPAP | 15,170 | MLVBM_Q7SVK7 |
| EAAAKEAAAKEAAAK | 15,171 | HTL1C_P14078 |
| GSSGGSEAAAK | 15,172 | SRV2_P51517 |
| PAPGGGGGS | 15,173 | SRV2_P51517 |
| GGGEAAAK | 15,174 | FFV_093209-Pro_2mut |
| EAAAKGGGPAP | 15,175 | HTL32_QOR5R2 |
| GGSGSSGGG | 15,176 | MMTVB_P03365 |
| PAPEAAAKGSS | 15,177 | MMTVB_P03365-Pro |
| PAPGGGGGS | 15,178 | MMTVB_P03365-Pro |
| EAAAKGGGGS | 15,179 | MMTVB_P03365_WS |
| GGGGS | 15,180 | MMTVB_P03365-Pro |
| GGGGSGGGGSGGGGSGGGGSGGGGS | 15,181 | HTL1C_P14078 |
| EAAAKGGSPAP | 15,182 | MMTVB_P03365 |
| GGGGSSPAP | 15,183 | FFV_093209-Pro_2mut |
| GGGGSSGGS | 15,184 | MMTVB_P03365-Pro |
| PAPGSSGGS | 15,185 | MMTVB_P03365-Pro |
| GGGGS | 15,186 | SRV2_P51517 |
| GGSGSSGGG | 15,187 | MMTVB_P03365 |
| GSSGGSEAAAK | 15,188 | MMTVB_P03365-Pro |
| EAAAKEAAAKEAAAKEAAAK | 15,189 | GALV_P21414 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSEAAAKGGG | 15,190 | MMTVB_P03365-Pro |
| SGGSSGGSSGSETPGTSESATPESSGGSSGGSS | 15,191 | MMTVB_P03365-Pro |
| GSSEAAAKGGS | 15,192 | MMTVB_P03365 |
| GGGGSGGGGSGGGGSGGGGSGGGGSGGGGS | 15,193 | HTL3P_Q4U0X6_2mutB |
| GGGEAAAK | 15,194 | MMTVB_P03365-Pro |
| PAPAPAPAP | 15,195 | MMTVB_P03365-Pro |
| PAPGSSGGG | 15,196 | MMTVB_P03365 |
| GSSGSSGSSGSSGSS | 15,197 | GALV_P21414 |
| GGSPAP | 15,198 | MMTVB_P03365_WS |
| GGGGSGGGGSGGGGSGGGGSGGGGSGGGGS | 15,199 | MMTVB_P03365-Pro |
| PAPEAAAK | 15,200 | MMTVB_P03365-Pro |
| PAPGSSGGG | 15,201 | SFV1_P23074-Pro_2mutA |
| GGGGGSEAAAK | 15,202 | MMTVB_P03365_2mutB_WS |
| PAPAPAPAPAP | 15,203 | MMTVB_P03365-Pro |
| EAAAKGGSGSS | 15,204 | MMTVB_P03365-Pro |
| EAAAKEAAAKEAAAKEAAAK | 15,205 | MLVRD_P11227_3mut |
| PAPAPAPAP | 15,206 | FOAMV_P14350_2mutA |
| GGGPAPGSS | 15,207 | SFVCP_Q87040_2mut |
| PAPEAAAKGSS | 15,208 | SFVCP_Q87040_2mut |
| GGSPAPGGG | 15,209 | MMTVB_P03365-Pro |
| GGGGSGGGGSGGGGSGGGGS | 15,210 | MMTVB_P03365 |
| EAAAKGGS | 15,211 | HTL3P_Q4U0X6_2mut |
| PAPGSSGGS | 15,212 | MMTVB_P03365_WS |
| GGGGSGGGGS | 15,213 | MMTVB_P03365 |
| GGSGGS | 15,214 | FOAMV_P14350 |
| EAAAKGGGGSEAAAK | 15,215 | SFVCP_Q87040-Pro_2mut |
| EAAAKEAAAKEAAAKEAAAK | 15,216 | MMTVB_P03365-Pro_2mutB |
| PAPGGGEAAAK | 15,217 | SFVCP_Q87040-Pro |
| GSSGSS | 15,218 | JSRV_P31623_2mutB |
| EAAAKGGGGS | 15,219 | MMTVB_P03365_2mut_WS |
| GSSPAPEAAAK | 15,220 | MMTVB_P03365-Pro |
| GGGEAAAK | 15,221 | HTL1C_P14078 |
| PAPEAAAKGSS | 15,222 | HTL32_QOR5R2_2mutB |
| GGGGSSEAAAK | 15,223 | MMTVB_P03365-Pro |
| PAPGSSGGS | 15,224 | MMTVB_P03365-Pro |
| EAAAKGGGGS | 15,225 | MMTVB_P03365 |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGGGSGGGGSGGGGSGGGGS | 15,226 | MMTVB_P03365 |
| EAAAKGGGSS | 15,227 | HTL3P_Q4U0X6_2mut |
| GGGEAAAKGGS | 15,228 | SFVCP_Q87040-Pro |
| GGGGGSPAP | 15,229 | MMTVB_P03365-Pro_2mutB |
| GGSGGGEAAAK | 15,230 | SFV3L_P27401-Pro |
| PAPGGGGS | 15,231 | SFV3L_P27401-Pro |
| EAAAKGGGGSEAAAK | 15,232 | MMTVB_P03365 |
| PAPEAAAKGSS | 15,233 | MMTVB_P03365-Pro |
| GGSEAAAKGGG | 15,234 | MMTVB_P03365-Pro |
| GGSGGSGGSGGSGGS | 15,235 | SMRVH_P03364_2mutB |
| GGSGGSGGSGGSGGS | 15,236 | HTL1L_P0C211_2mut |
| GGGGGG | 15,237 | WDSV_092815 |
| GGGGGSGSS | 15,238 | MMTVB_P03365-Pro |
| GGSEAAAKPAP | 15,239 | SFV3L_P27401-Pro_2mut |
| GGGPAPGSS | 15,240 | MMTVB_P03365_2mut_WS |
| GGGGGS | 15,241 | MMTVB_P03365_WS |
| GGSPAPEAAAK | 15,242 | MMTVB_P03365 |
| PAPEAAAKGGS | 15,243 | HTL1A_P03362 |
| EAAAKGGSGSS | 15,244 | MMTVB_P03365_2mut_WS |
| GGGPAPEAAAK | 15,245 | SFV3L_P27401-Pro_2mut |
| PAPGGGGSS | 15,246 | HTL32_Q0R5R2_2mut |
| GSSPAPGGG | 15,247 | HTL3P_Q4U0X6_2mut |
| GGGGSSGGS | 15,248 | BLVAU_P25059_2mut |
| EAAAKGGGGS | 15,249 | HTL1L_P0C211 |
| GGSEAAAKGSS | 15,250 | JSRV_P31623_2mutB |
| GSSGGG | 15,251 | JSRV_P31623 |
| GGSGGSGGSGGS | 15,252 | MMTVB_P03365-Pro |
| EAAAKPAP | 15,253 | SFV1_P23074-Pro_2mutA |
| GGGGSSGGS | 15,254 | MMTVB_P03365_WS |
| GGSGGS | 15,255 | MMTVB_P03365_WS |
| EAAAKGGGGS | 15,256 | MMTVB_P03365-Pro |
| GGGGSGGGGSGGGGSGGGGSGGGGSGGGGS | 15,257 | MMTVB_P03365 |
| GGSGGSGGS | 15,258 | MMTVB_P03365 |
| GGGGGSEAAAK | 15,259 | MLVBM_Q7SVK7 |
| GGSGSSPAP | 15,260 | MMTVB_P03365_WS |
| EAAAKEAAAKEAAAK | 15,261 | JSRV_P31623 |
| PAPEAAAKGGS | 15,262 | MMTVB_P03365-Pro |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GGSGSSEAAAK | 15,263 | FOAMV_P14350 |
| GGGGGSGSS | 15,264 | MMTVB_P03365-Pro_2mut |
| GGGPAPGGS | 15,265 | MMTVB_P03365 |
| SGSETPGTSESATPES | 15,266 | SFVCP_Q87040_2mut |
| GSSPAPGGS | 15,267 | SFV1_P23074-Pro_2mutA |
| GSSGSSGSSGSSGSS | 15,268 | MMTVB_P03365 |
| EAAAKGGGPAP | 15,269 | MMTVB_P03365 |
| GSSGGG | 15,270 | MMTVB_P03365_2mut_WS |
| GGGEAAAKPAP | 15,271 | MMTVB_P03365 |
| PAPGGSGGG | 15,272 | MMTVB_P03365-Pro |
| GSSGGSGGG | 15,273 | WDSV_092815_2mut |
| GGSGGG | 15,274 | HTL32_QOR5R2_2mut |
| EAAAKGGSPAP | 15,275 | HTLV2_P03363_2mut |
| GGSPAPEAAAK | 15,276 | MMTVB_P03365-Pro |
| GSSGGSEAAAK | 15,277 | MMTVB_P03365_2mut |
| GSAGSAAGSGEF | 15,278 | MMTVB_P03365_WS |
| PAPGGSGSS | 15,279 | FFV_093209 |
| GGSEAAAKGGG | 15,280 | MMTVB_P03365 |
| GGSPAPGSS | 15,281 | MMTVB_P03365-Pro |
| GSSGGSGGG | 15,282 | SFV3L_P27401 |
| PAPEAAAKGGG | 15,283 | HTL1A_P03362_2mutB |
| GGGEAAAKPAP | 15,284 | MMTVB_P03365-Pro |
| GGSEAAAK | 15,285 | HTL32_QOR5R2_2mutB |
| GGGEAAAKGSS | 15,286 | MPMV_P07572 |
| GGGGGSEAAAK | 15,287 | MMTVB_P03365-Pro |
| PAPAPAPAPAP | 15,288 | SFVCP_Q87040-Pro_2mutA |
| PAPAPAPAPAP | 15,289 | HTL1L_POC211_2mut |
| GGGGSSGGS | 15,290 | HTL3P_Q4U0X6 |
| PAPGGSEAAAK | 15,291 | MMTVB_P03365_2mut_WS |
| PAPAPAPAPAP | 15,292 | HTL1A_P03362 |
| EAAAKPAPGGG | 15,293 | MMTVB_P03365_2mut_WS |
| GGSEAAAK | 15,294 | MMTVB_P03365_2mut_WS |
| GGGEAAAKGSS | 15,295 | SFV1_P23074-Pro_2mutA |
| GGSPAPGSS | 15,296 | MMTVB_P03365-Pro |
| GGSEAAAKPAP | 15,297 | MLVBM_Q7SVK7 |
| PAPEAAAKGGG | 15,298 | MMTVB_P03365_2mut_WS |

TABLE 1-continued

Combinations of linker and RT sequences screened. The amino acid sequence of each RT in this table is provided in Table 6.

| Linker amino acid sequence | SEQ ID NO: of Linker | RT domain name |
|---|---|---|
| GSSEAAAKPAP | 15,299 | MMTVB_P03365-Pro_2mutB |
| GGGGSEAAAKGGGGS | 15,300 | MMTVB_P03365-Pro_2mut |
| GSSEAAAKGGS | 15,301 | MMTVB_P03365-Pro_2mutB |
| GSSGSSGSSGSSGSS | 15,302 | SRV2_P51517_2mutB |
| GGGGGSPAP | 15,303 | HTL1L_P0C211_2mut |
| GGSEAAAK | 15,304 | MMTVB_P03365 |
| GSSPAPEAAAK | 15,305 | SMRVH_P03364_2mutB |
| GGGPAPGGS | 15,306 | HTL1C_P14078_2mut |
| GGSPAPEAAAK | 15,307 | MMTVB_P03365_WS |
| GGSEAAAKPAP | 15,308 | HTL1A_P03362_2mut |
| PAPAPAPAP | 15,309 | HTLV2_P03363_2mut |
| GSSPAPGGG | 15,310 | MMTVB_P03365 |
| GSSGSSGSSGSS | 15,311 | MMTVB_P03365-Pro |
| GGSEAAAKGSS | 15,312 | MMTVB_P03365_WS |
| GGSGSSGGG | 15,313 | MMTVB_P03365_2mutB |
| GSSGSSGSSGSSGSSGSS | 15,314 | JSRV_P31623_2mutB |
| GGSEAAAKPAP | 15,315 | MMTVB_P03365-Pro |
| GSSGGSGGG | 15,316 | HTLV2_P03363_2mut |
| AEAAAKEAAAKEAAAKEAAAKALEAEAAAKEAAAKEAAAKEAAAKA | 15,317 | WDSV_092815_2mut |
| GGSPAPEAAAK | 15,318 | MMTVB_P03365 |
| GGGGSSEAAAK | 15,319 | MMTVB_P03365 |
| GGSGGGEAAAK | 15,320 | SFV1_P23074-Pro_2mutA |
| GGGGSEAAAKGGGGS | 15,321 | WDSV_092815_2mut |
| GGSGSSEAAAK | 15,322 | MMTVB_P03365_2mutB_WS |
| GGSEAAAKPAP | 15,323 | MMTVB_P03365_WS |
| GSSGGGEAAAK | 15,324 | SFVCP_Q87040-Pro |
| GSSGGS | 15,325 | SFVCP_Q87040-Pro_2mut |
| GGSEAAAKPAP | 15,326 | SFVCP_Q87040_2mut |
| GSSGGSEAAAK | 15,327 | SFVCP_Q87040_2mut |
| GSSPAPEAAAK | 15,328 | SRV2_P51517_2mutB |
| GGSGGSGGSGGSGGS | 15,329 | BLVAU_P25059 |
| GSSGSSGSSGSSGSS | 15,330 | HTL1C_P14078_2mut |
| EAAAKGGGGSS | 15,331 | MMTVB_P03365_2mutB |
| GGGEAAAKGSS | 15,332 | SFVCP_Q87040-Pro |

Example 3: Sequencing Analysis of Pooled Screening of Gene Modifying Polypeptides in HEK293T and U2OS Cells This example describes identification and characterization of several classes of gene modifying polypeptides capable of editing genomic DNA.

Genomic DNA was extracted from pools of the sorted and unsorted cell populations in Example 2 and analysed as described in Example 1. Specifically, DNA libraries were prepared by PCR amplification of candidate gene modifying polypeptide sequences. Libraries were sequenced using long read sequencing using an Oxford Nanopore Technologies sequencer protocol Amplicons by Ligation SQK-LSK110. Raw sequencing reads were processed using MinKNOW (Oxford Nanopore Technologies) to perform base-calling and standard quality filtering. The filtered sequencing reads were then mapped against a reference consisting of full-length DNA sequences for all possible library candidates. Following mapping, the data were further processed to remove reads not satisfying requirements for minimum and maximum length, excessive truncation, chimerism, and minimum sequence identity to improve mapping confidence. The surviving data were then normalized to counts-per-million to adjust for sequencing depth. Normalized counts from unsorted populations were used as baseline for their respective sorted populations to calculate fold-change enrichment for each candidate. Finally, fold-change values were log 2 transformed and Z-score normalized.

Figure 4C:
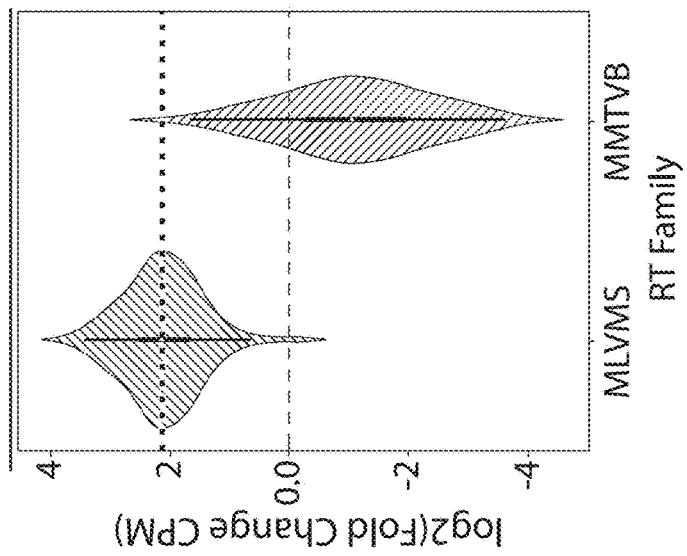
FIGS. 4A-4C are a series of graphs depicting editing activity of two exemplary gene modifying polypeptides, MLVMS and MMTVB.
Figure 4B:
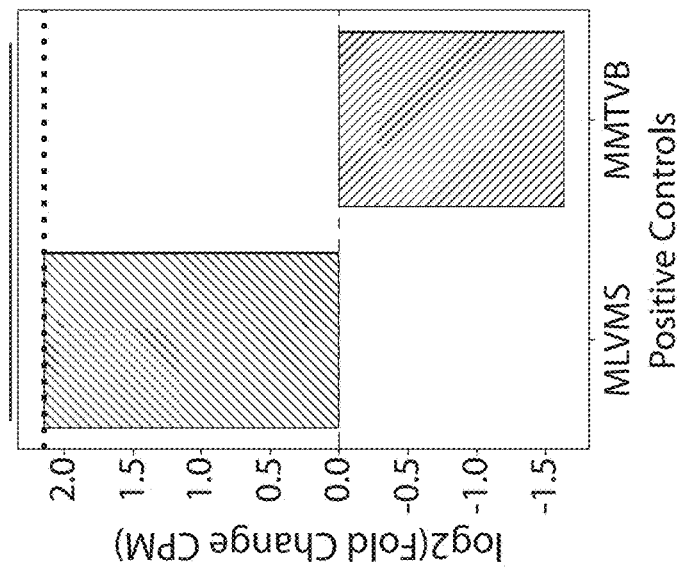
Figure 4A:
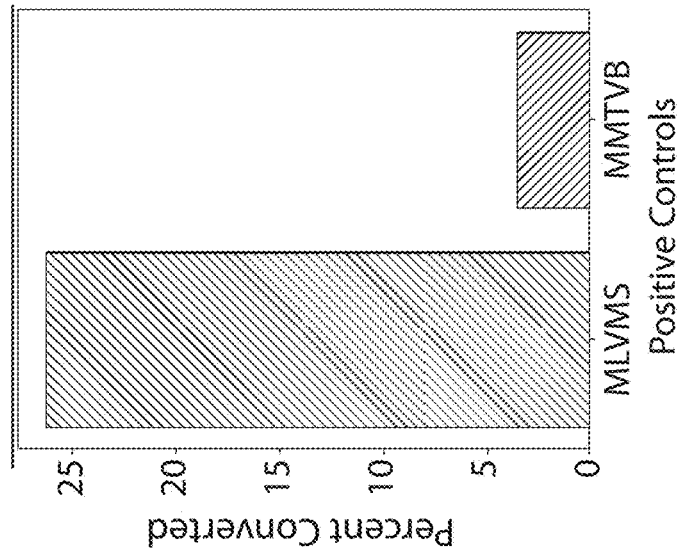
Figure 5A:
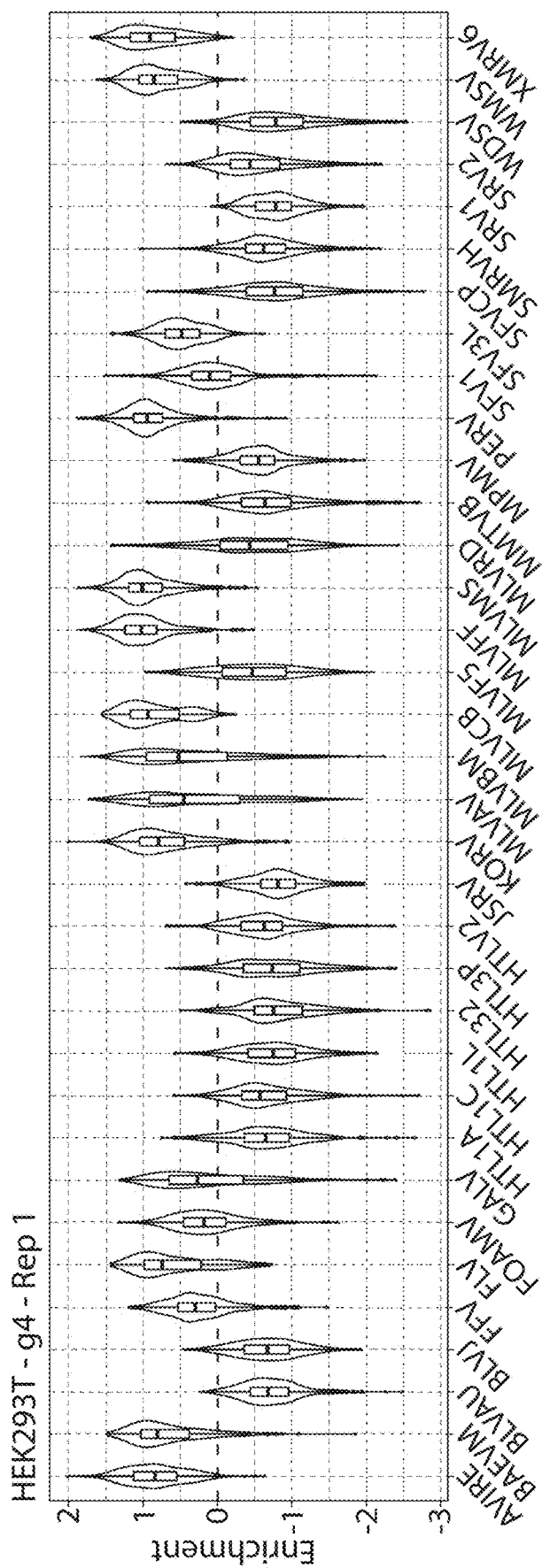
FIGS. 5A-5G provide violin plots showing enrichment of exemplary gene modifying polypeptides grouped by RT family.
Figure 5B:
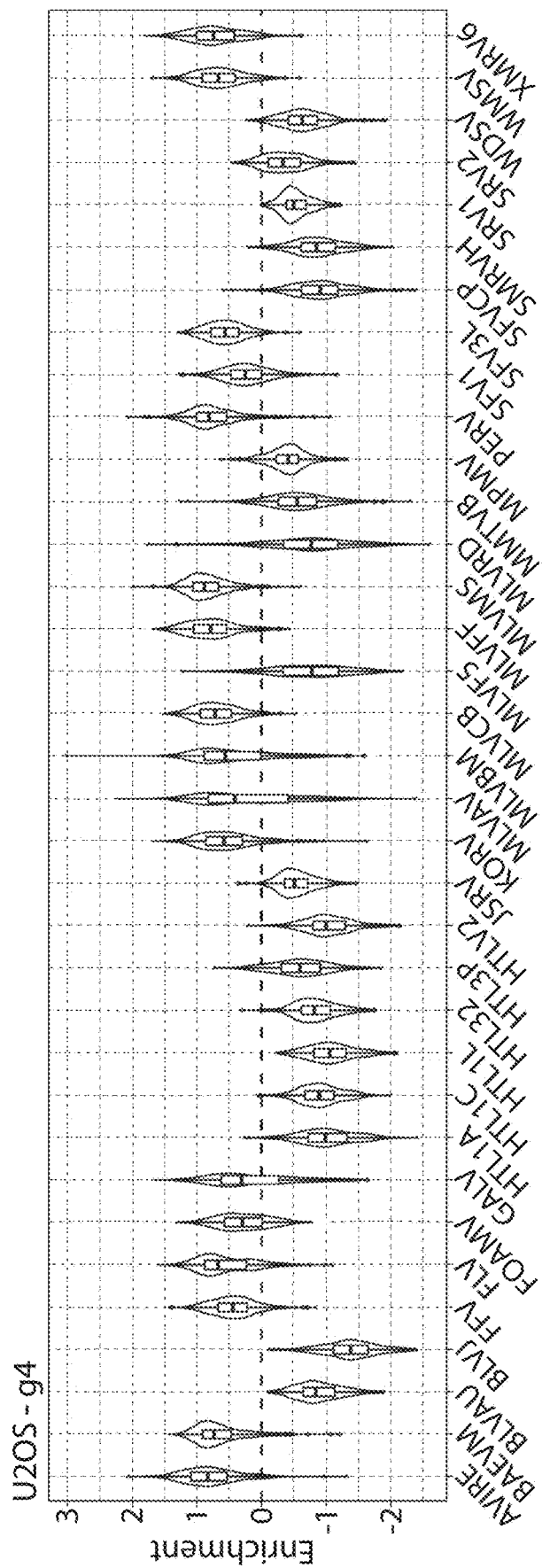
Figure 5C:
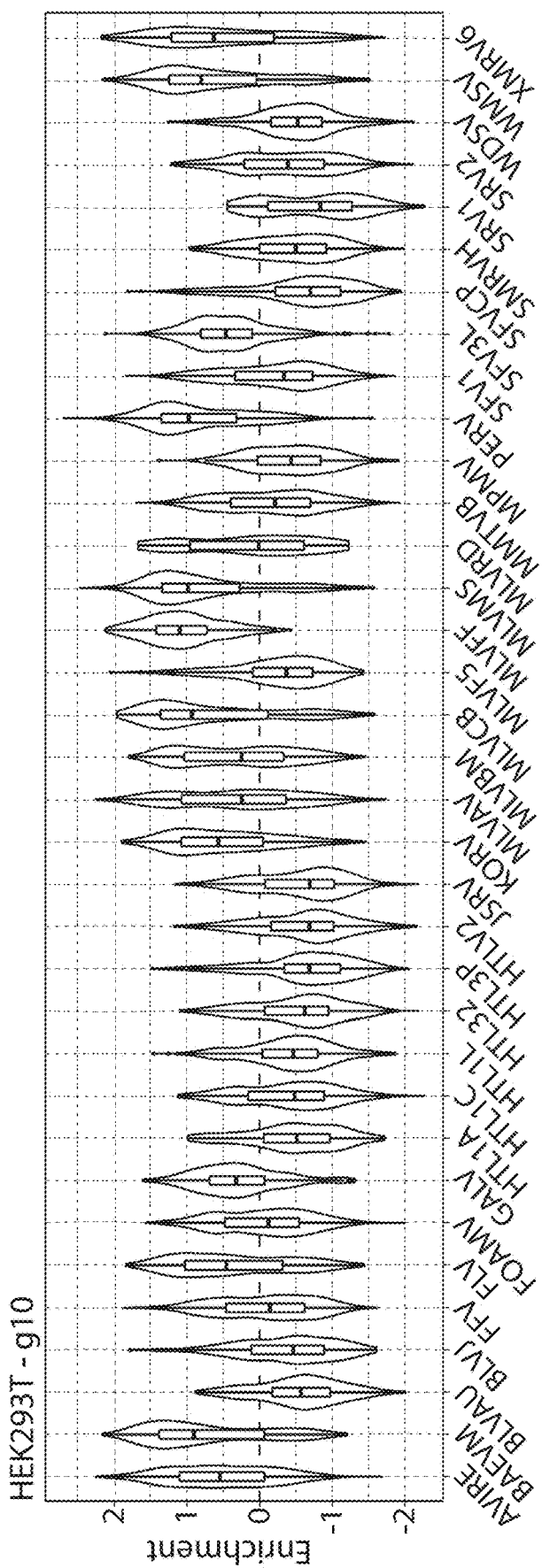
Figure 5D:
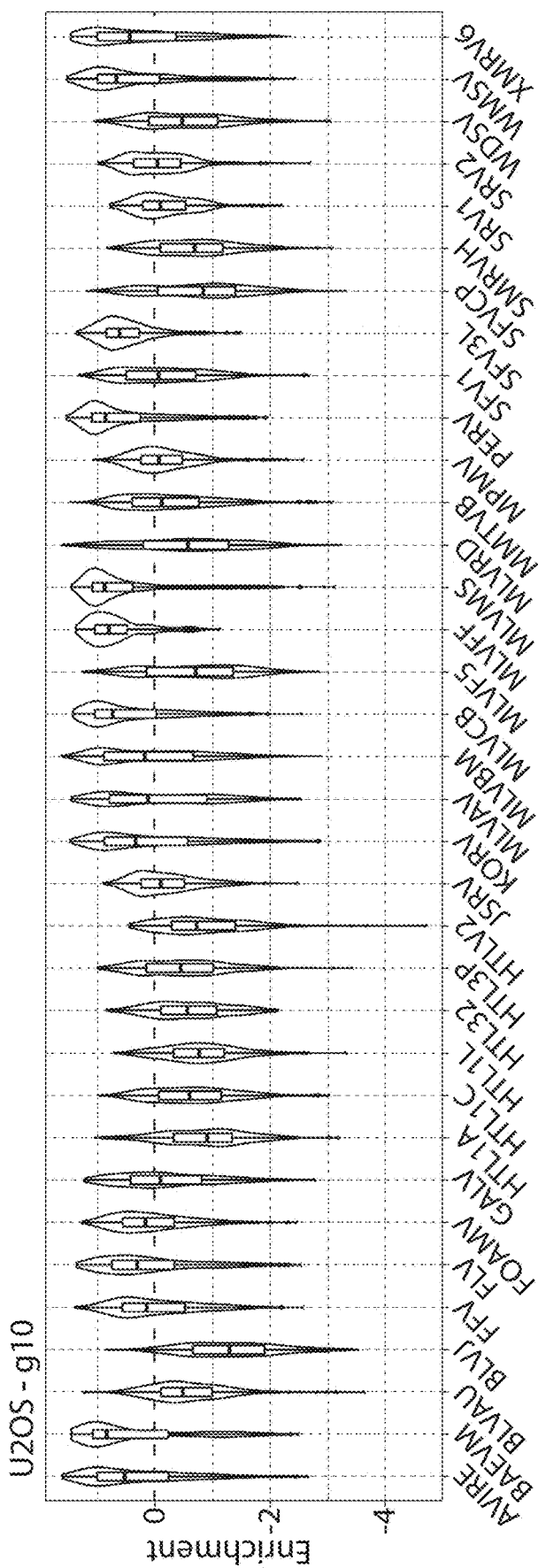
Figure 5E:
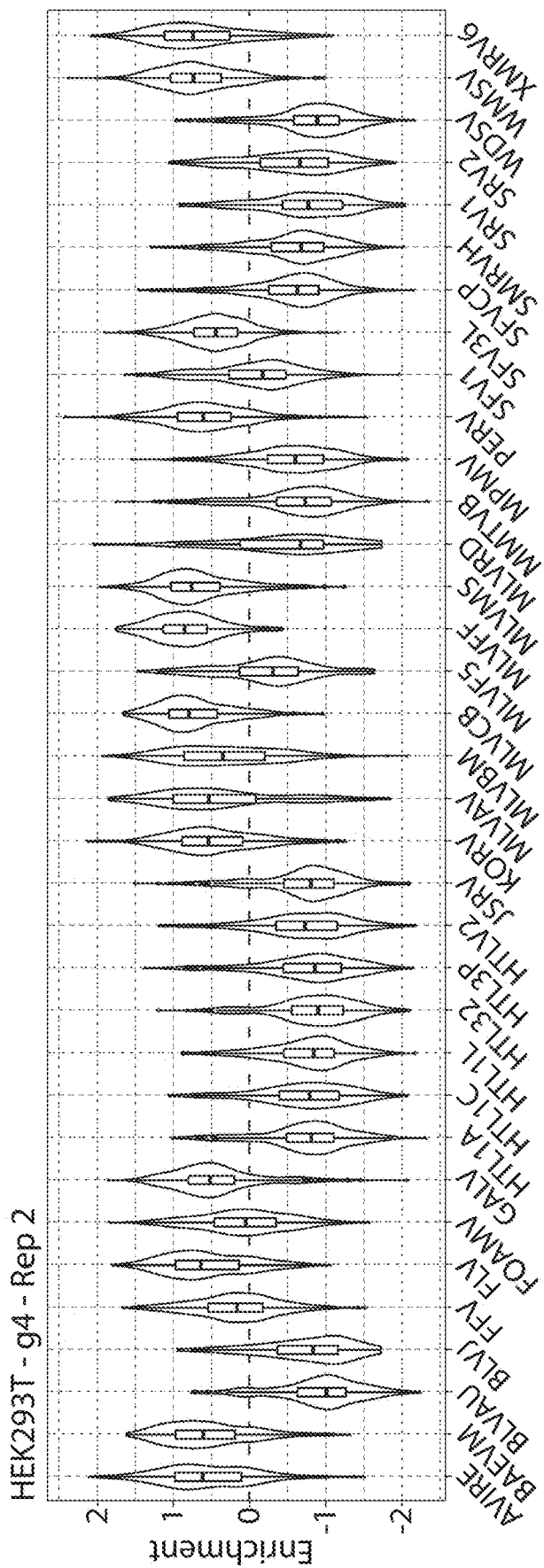
Figure 5F:
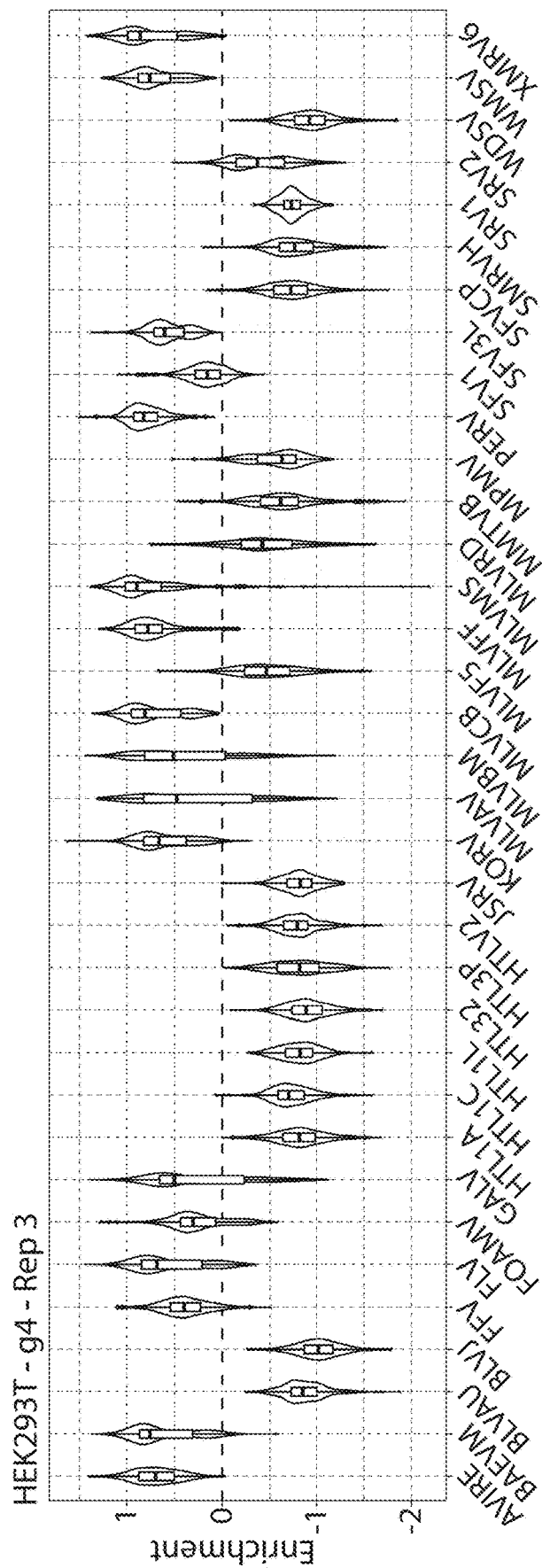
Figure 5G:
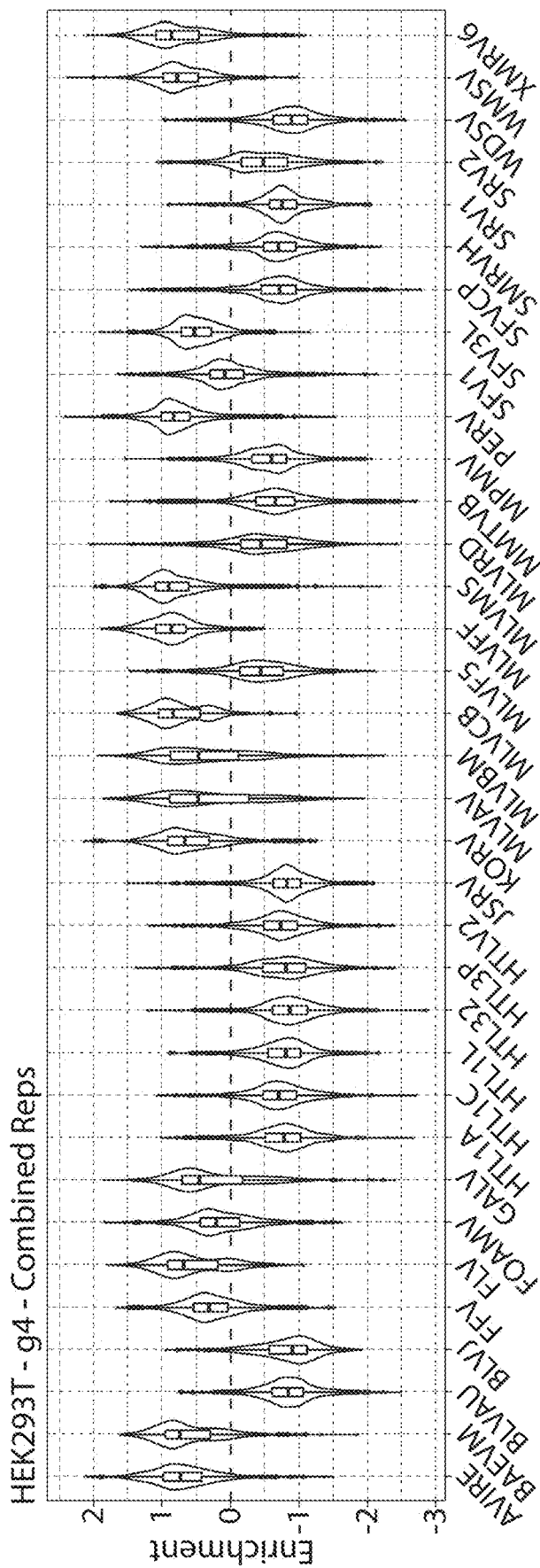

Cells infected with lentiviral pools encoding gene modifying polypeptides comprising MLVMS RT having high editing activity with several linkers were used as a positive control and cells infected with lentiviral pools encoding gene modifying polypeptides comprising MMTVB RT having low editing activity were used as a negative control to confirm that sequencing analyses were consistent with known editing assay results (FIGS. 4A-4C). The results showed that the assay distinguishes between gene modifying polypeptides containing high activity RTs and low activity RTs (FIGS. 4A-4B). The results further showed that the activity trends associated with the positive control RT and negative control RT selected are consistent across all members of a given RT family tested, e.g., for each of the MLVMS RT sequences and each of the MMTVB RT sequences across multiple linkers tested (FIG. 4C). These data indicate that the identity of the RT domain plays a significant role in determining editing activity of a gene modifying polypeptide.

Figure 7:
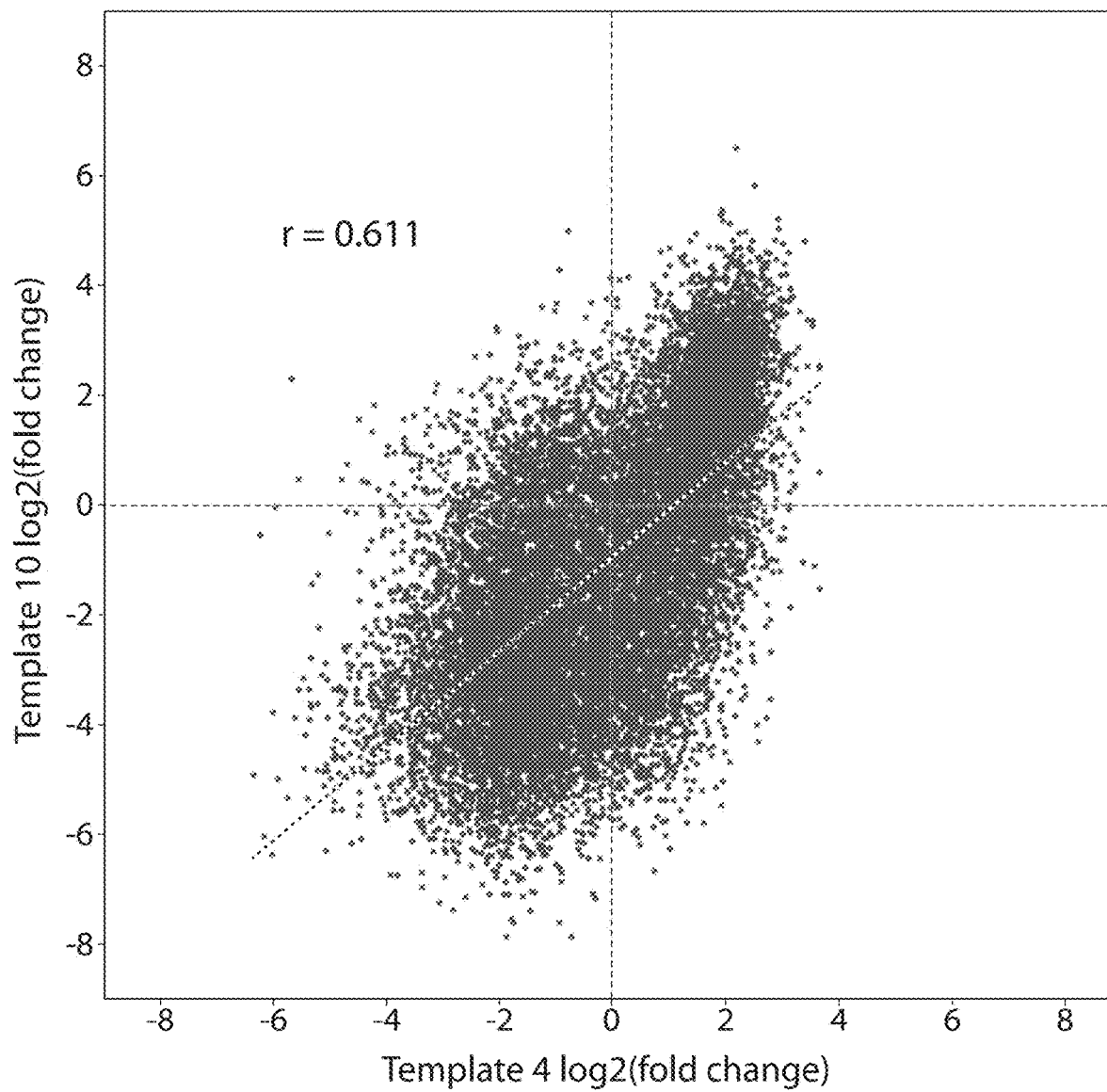
FIG. 7 shows a graph of enrichment of exemplary gene modifying polypeptides when editing activity was tested with exemplary template RNA g4 (X-axis) or with exemplary template RNA g10 (Y-axis). A linear regression line is plotted based upon the scatter plot data.
Figure 8C:
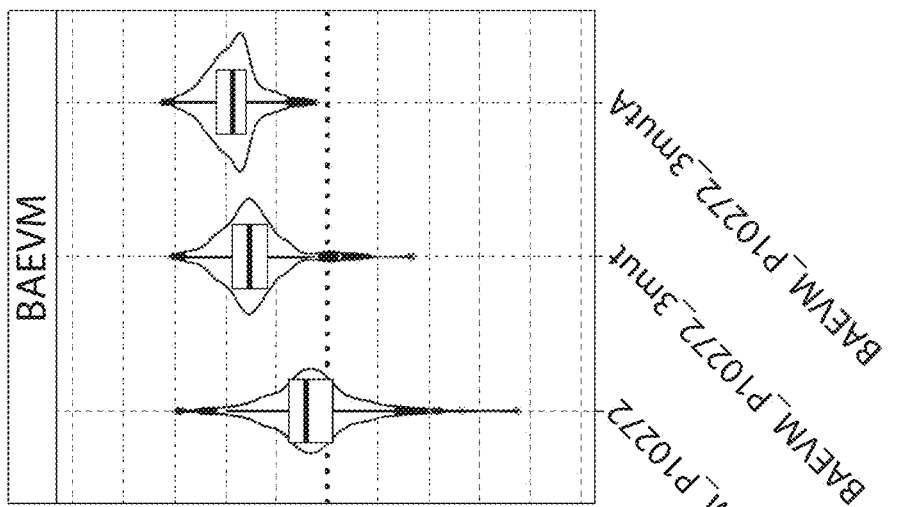
FIGS. 8A-8F provide violin plots showing enrichment of exemplary gene modifying polypeptides grouped by RT family (FIG. 8A MLVAV, FIG. 8B MLVBM, FIG. 8C BAEVM, FIG. 8D FLV, FIG. 8E FOAMV, FIG. 8F GALV), where the wild-type RT family gene modifying polypeptide is given at left, followed at right by gene modifying polypeptides comprising an increasing number of substitution mutations.
Figure 8B:
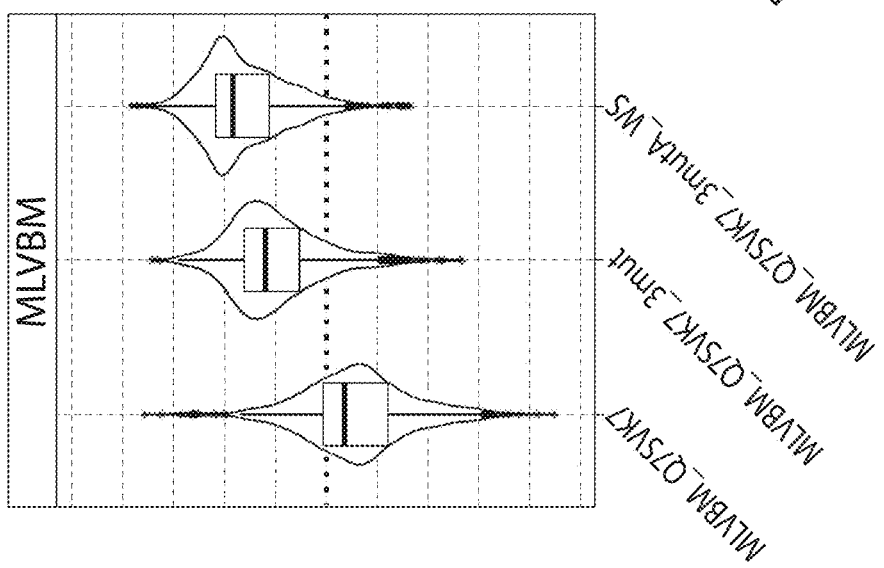
Figure 8A:
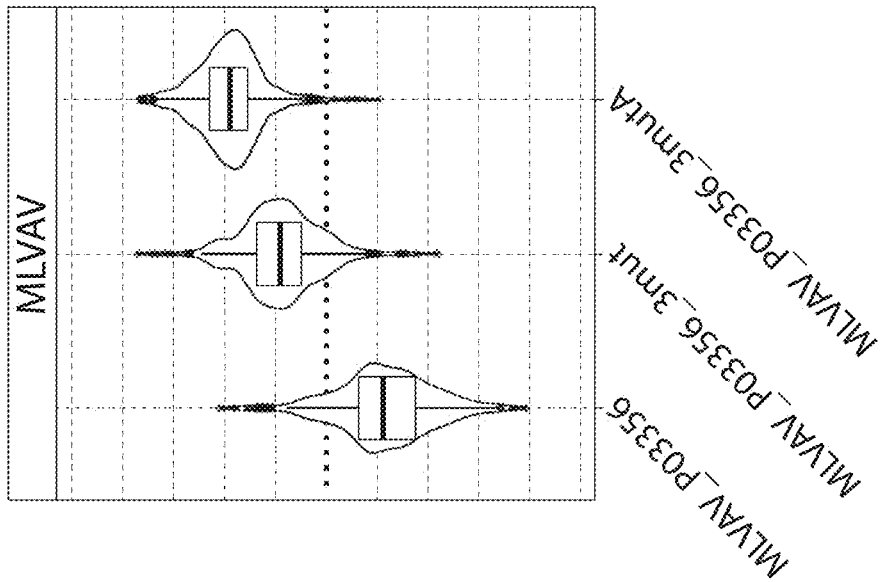
Figure 8F:
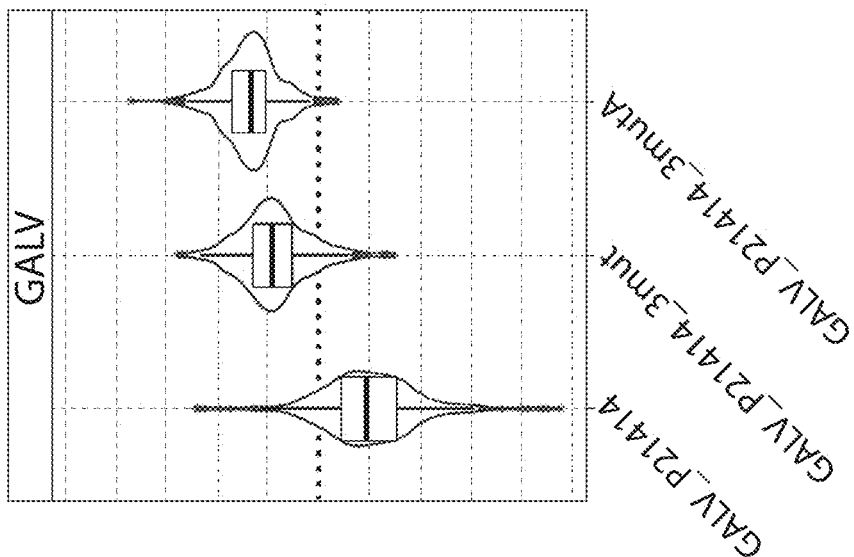
Figure 8E:
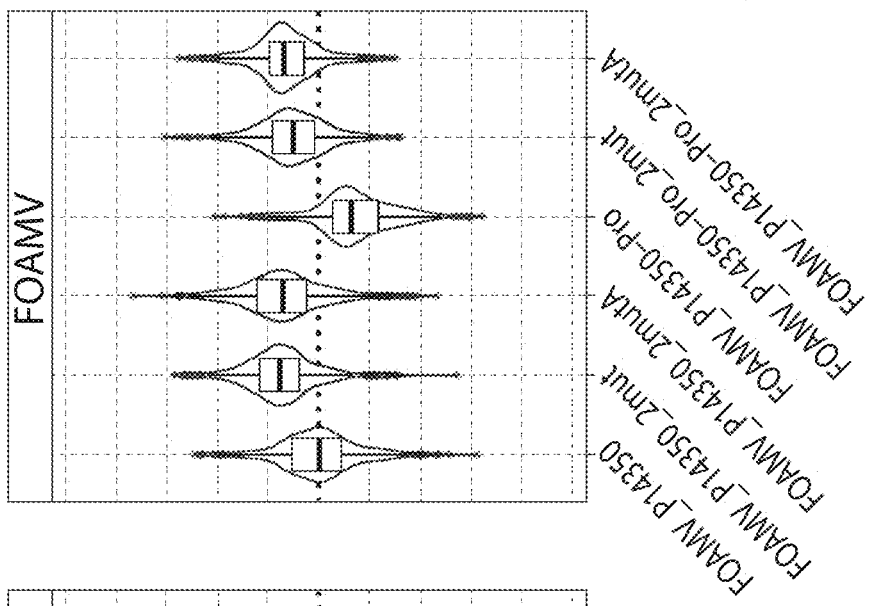
Figure 8D:
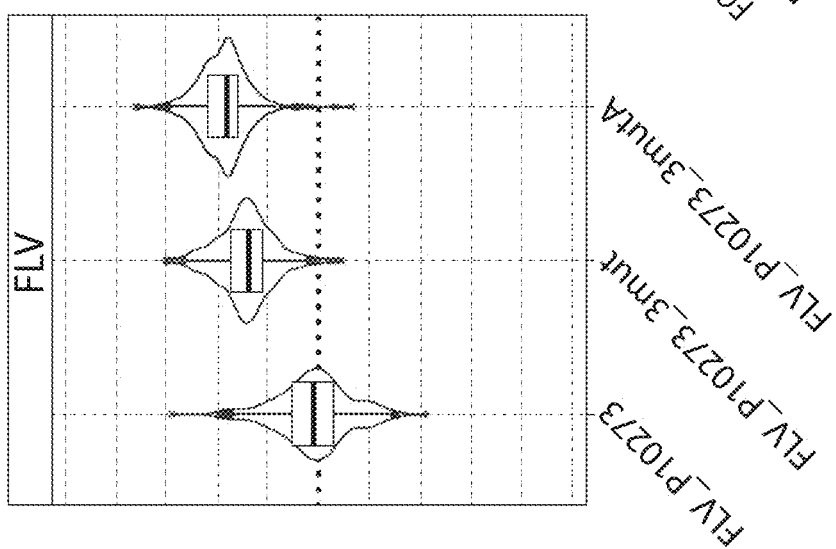
Figure 9A:
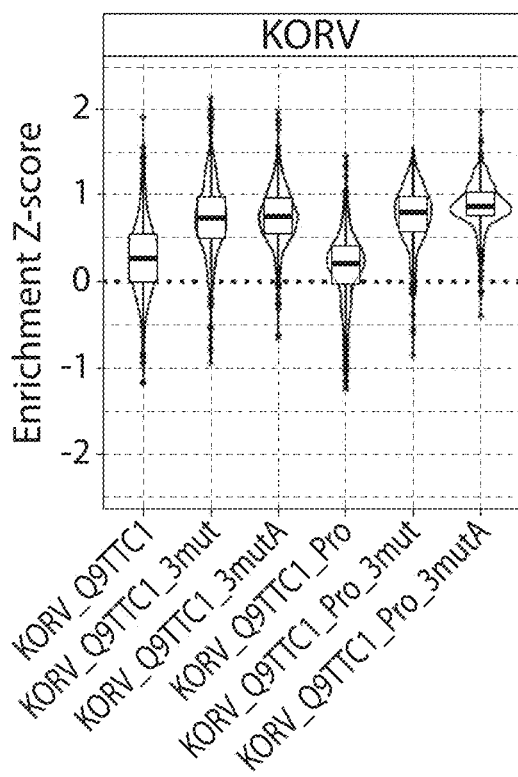
FIGS. 9A-9H provide violin plots showing enrichment of exemplary gene modifying polypeptides grouped by RT family (FIG. 9A KORV, FIG. 9B AVIRE, FIG. 9C MLVCB, FIG. 9D MLVFF, FIG. 9E MLVMS, FIG. 9F SFV3L, FIG. 9G WMSV, FIG. 9H XMRV6), where the wild-type RT family gene modifying polypeptide is given at left, followed at right by gene modifying polypeptides comprising an increasing number of substitution mutations. For KORV and SFV3L RT families, variants deleting/disabling the protease domain of the RT domain were also evaluated.
Figure 9B:
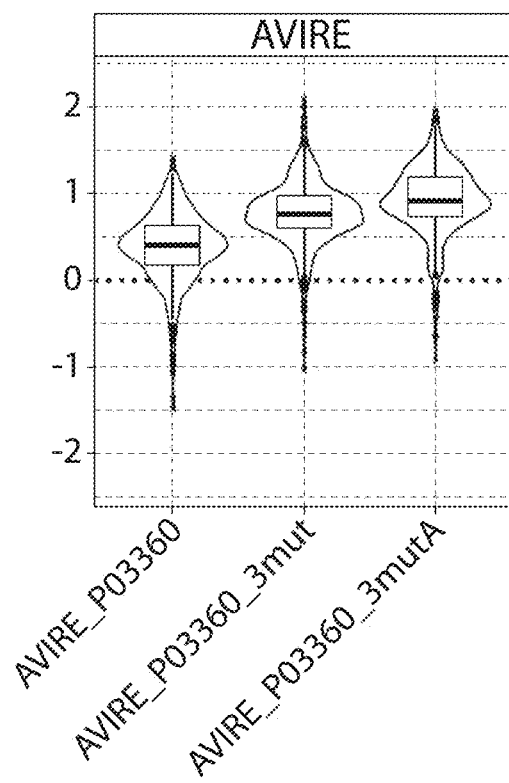
Figure 9E:
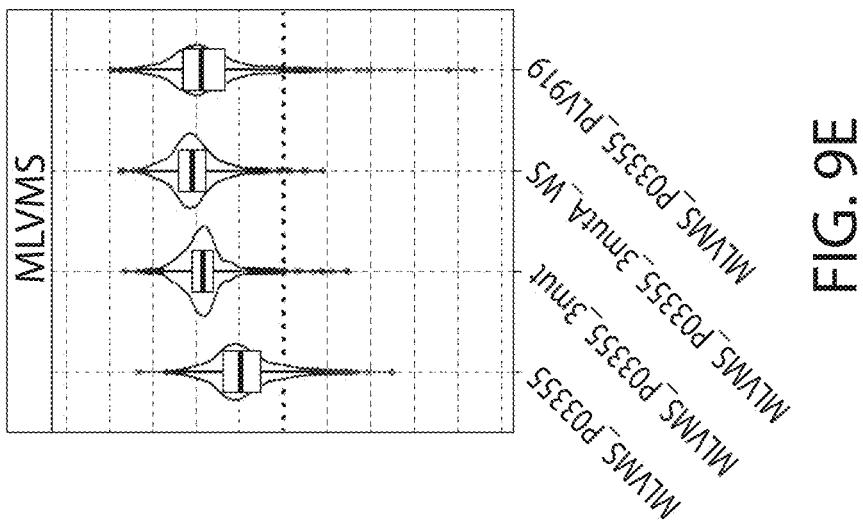
Figure 9D:
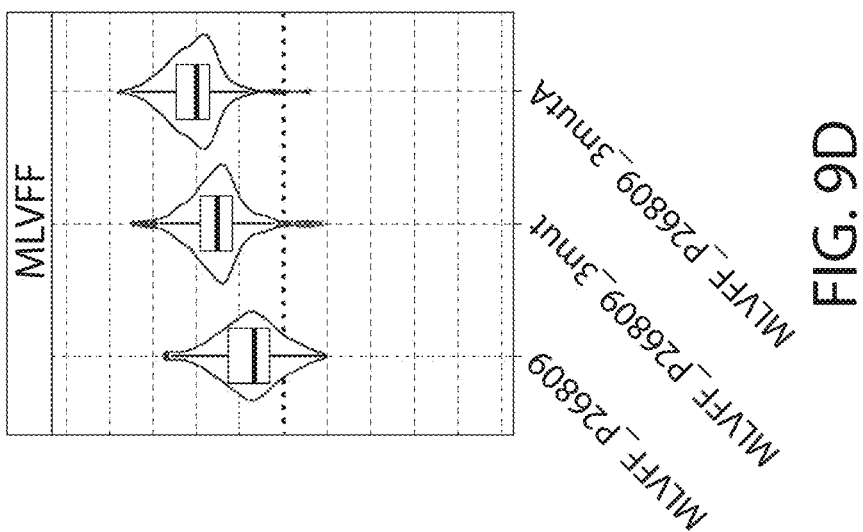
Figure 9C:
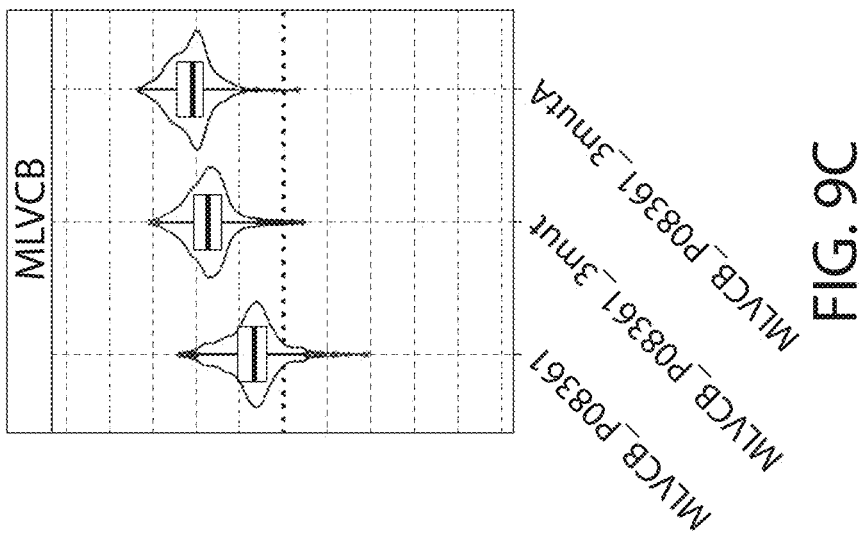
Figures 9F, 9G, 9H:
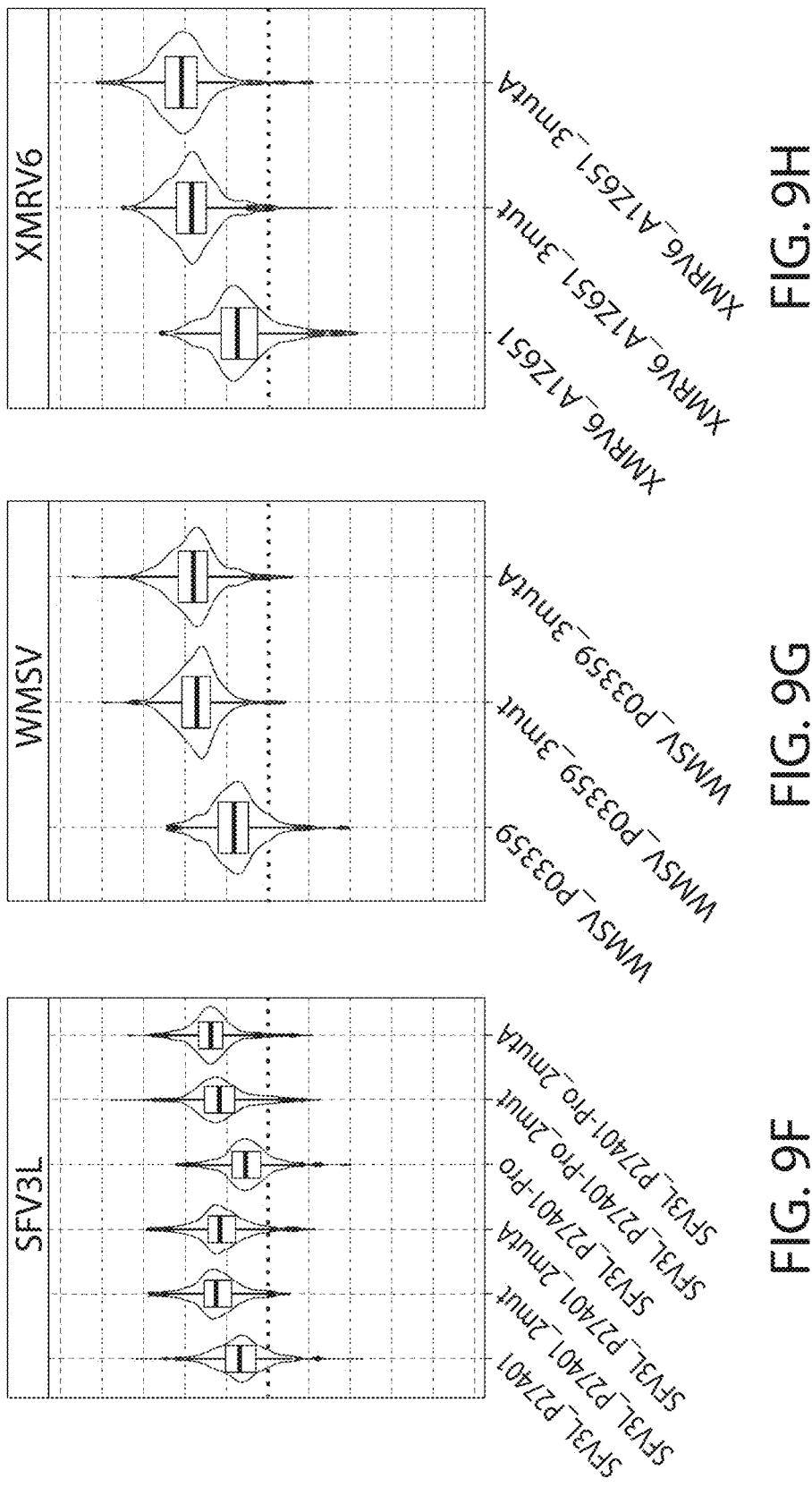

The genome-editing capacity of gene modifying library candidates tested was assessed across four conditions, using two different templates and two different cell lines: template g4 in HEK293T cells (condition 1), template g4 in U2OS cells (condition 2), template g10 in HEK293T cells (condition 3), and template g10 in U2OS cells (condition 4). Genome editing activity was plotted as log 2 (Fold Change CPM) in a violin plot and the data for candidates were sorted by RT family (FIGS. 5A-5D). The results showed editing activity for gene modifying candidates containing linkers paired with RT sequences from across 17 different retroviral RT families tested in the assay: AVIRE, BAEVM, FFV, FLV, FOAMV, GALV, KORV, MLVAV, MLVBM, MLVCB, MLVFF, MLVMS, PERV, SFV1, SFV3L, WMSV, and XMRV6. In contrast, gene modifying candidates with RT sequences from other RT families tested lacked editing activity or had lower levels of editing activity. Regression analysis showed that editing activity of gene modifying polypeptide candidates was correlated across HEK293T and U2OS conditions (FIG. 6), as well as across templates g4 and g10 (FIG. 7). The overall activity trends of all candidate gene modifying polypeptides showed that editing activity remained consistent across the four conditions tested, suggesting that gene modifying polypeptide editing activity may translate across different cell types and templates.

Data from the four conditions tested were analyzed to select subsets of gene modifying polypeptide candidates displaying consistent and robust evidence of genome editing activity. Namely, selected candidates were required to exhibit an enrichment Z-score of 1 or higher in one or more of the template g4 conditions in HEK293T and U2OS cells (conditions 1 and 2, respectively) and the test template g10 condition in HEK293T cells (condition 3). Data from the test template g10 condition (condition 4) in U2OS cells were omitted from initial analysis. An exemplary selection analysis is depicted graphically in FIG. 14 which displays gene modifying candidates showing high genome editing activity across both cells types for test template g4 and in HEK293T cells for test template g10 in HEK293T cells.

Figure 14:
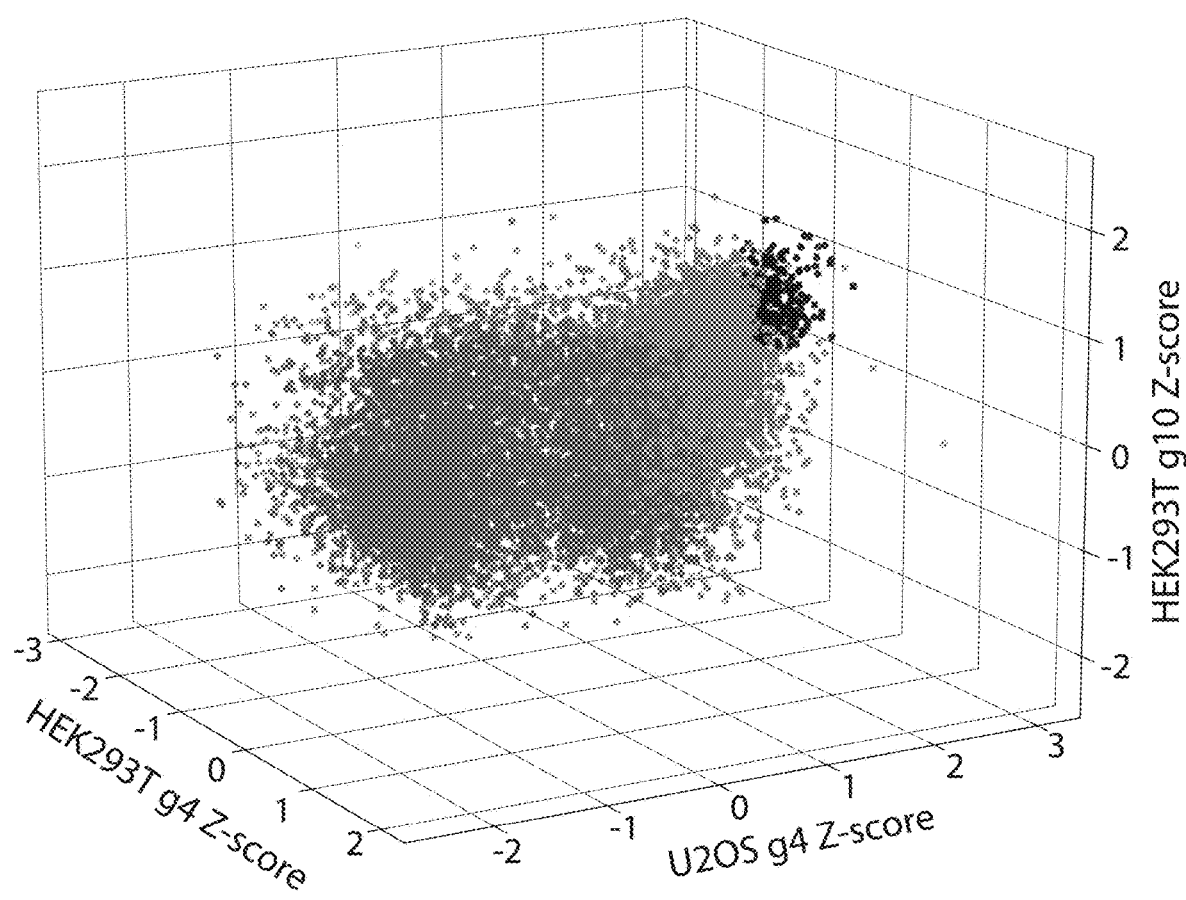
FIG. 14 is a graph showing the Z-scores of a library of gene modifying polypeptide candidates in each of three conditions.

Approximately 3180 gene modifying polypeptide candidates within the library had a Z-score of at least 1 or greater in any one of conditions 1, 2, or 3. These results show that this subset of gene modifying polypeptides had editing activity in at least one condition of the screening assay (FIG. 14, light and dark dots). The subset of these gene modifying polypeptides are encoded by amino acid sequences of any one of the SEQ ID NOs listed in Table D1 below.

TABLE D1

Gene modifying polypeptide candidates having a Z-score of at least 1 or greater in any one of conditions 1, 2, or 3. SEQ ID NOs 1
2
3
4
5
6
7
9
10
13
14
17
19
22
33
34
35
36
37
38
39
40
41
42
43
44
45
46
47
48
49
50
51
52
53
54
55

TABLE D1-continued

Gene modifying polypeptide candidates having a Z-score of at least 1 or greater in any one of conditions 1, 2, or 3.
SEQ ID NOs 56
57
58
59
60
61
62
63
64
65
66
67
68
69
70
72
73
74
75
76
77
78
79
80
81
83
86
87
88
89
90
92
94
96
97
98
99
100
101
102
103
104
105
106
107
108
110
112
113
114
115
116
117
118
119
120
121
122
123
124
125
126
127
128
129
130
131
132
133
134
135
136
137

TABLE D1-continued

Gene modifying polypeptide candidates having a Z-score of at least 1 or greater in any one of conditions 1, 2, or 3.
SEQ ID NOs 138
139
140
141
142
143
144
145
146
147
148
149
150
151
153
154
156
157
158
159
160
161
162
164
165
166
167
168
169
170
171
172
173
175
176
180
181
183
184
185
190
191
192
194
195
196
198
199
200
201
203
205
206
207
208
209
210
211
212
213
215
216
217
218
219
223
225
227
228
229
230
232
234

TABLE D1-continued

Gene modifying polypeptide
candidates having
a Z-score of at least 1
or greater in any one of
conditions 1, 2, or 3.
SEQ ID NOs 235
236
237
238
239
240
241
242
243
244
245
248
249
252
253
254
255
256
257
258
259
261
262
263
264
265
268
269
270
271
273
274
278
279
280
281
283
285
290
293
294
295
298
300
302
303
304
305
306
308
309
310
311
312
313
315
316
317
318
319
320
321
322
323
324
325
327
328
329
330
331
332
333

TABLE D1-continued

Gene modifying polypeptide
candidates having
a Z-score of at least 1
or greater in any one of
conditions 1, 2, or 3.
SEQ ID NOs 334
335
336
337
338
339
340
341
342
343
344
345
346
348
349
350
351
352
353
354
355
356
357
359
360
361
362
363
364
365
367
368
369
370
371
372
373
374
376
377
378
380
382
384
385
386
388
389
391
392
394
395
396
397
398
399
400
402
403
404
407
408
409
413
415
416
423
426
428
438
449
450
452

TABLE D1-continued

Gene modifying polypeptide candidates having a Z-score of at least 1 or greater in any one of conditions 1, 2, or 3.
SEQ ID NOs

| SEQ ID NOs |
|---|
| 460 |
| 461 |
| 462 |
| 464 |
| 469 |
| 470 |
| 472 |
| 480 |
| 481 |
| 483 |
| 484 |
| 502 |
| 503 |
| 504 |
| 523 |
| 524 |
| 527 |
| 534 |
| 535 |
| 537 |
| 538 |
| 539 |
| 540 |
| 541 |
| 543 |
| 544 |
| 545 |
| 547 |
| 550 |
| 553 |
| 554 |
| 555 |
| 557 |
| 559 |
| 561 |
| 563 |
| 565 |
| 567 |
| 568 |
| 570 |
| 571 |
| 572 |
| 575 |
| 583 |
| 584 |
| 585 |
| 589 |
| 590 |
| 591 |
| 592 |
| 594 |
| 595 |
| 596 |
| 597 |
| 598 |
| 599 |
| 600 |
| 602 |
| 604 |
| 605 |
| 606 |
| 607 |
| 610 |
| 613 |
| 614 |
| 616 |
| 617 |
| 618 |
| 624 |
| 631 |
| 636 |
| 645 |
| 647 |
| 648 |
| 649 |
| 650 |
| 651 |
| 652 |
| 653 |
| 656 |
| 657 |
| 659 |
| 661 |
| 662 |
| 663 |
| 664 |
| 667 |
| 668 |
| 670 |
| 677 |
| 679 |
| 687 |
| 689 |
| 690 |
| 694 |
| 700 |
| 707 |
| 711 |
| 715 |
| 716 |
| 717 |
| 720 |
| 726 |
| 727 |
| 728 |
| 729 |
| 731 |
| 738 |
| 739 |
| 745 |
| 765 |
| 766 |
| 767 |
| 768 |
| 769 |
| 770 |
| 771 |
| 772 |
| 773 |
| 774 |
| 775 |
| 776 |
| 780 |
| 782 |
| 783 |
| 784 |
| 789 |
| 797 |
| 798 |
| 799 |
| 800 |
| 801 |
| 802 |
| 803 |
| 804 |
| 805 |
| 806 |
| 807 |
| 808 |
| 809 |
| 810 |
| 811 |
| 812 |
| 813 |
| 814 |
| 815 |

TABLE D1-continued

Gene modifying polypeptide candidates having a Z-score of at least 1 or greater in any one of conditions 1, 2, or 3.
SEQ ID NOs

| |
|---|
| 816 |
| 817 |
| 818 |
| 819 |
| 820 |
| 821 |
| 822 |
| 824 |
| 825 |
| 826 |
| 827 |
| 828 |
| 829 |
| 830 |
| 831 |
| 832 |
| 833 |
| 834 |
| 835 |
| 836 |
| 837 |
| 839 |
| 840 |
| 841 |
| 842 |
| 843 |
| 844 |
| 845 |
| 846 |
| 847 |
| 849 |
| 852 |
| 853 |
| 854 |
| 856 |
| 860 |
| 861 |
| 862 |
| 863 |
| 866 |
| 867 |
| 868 |
| 871 |
| 872 |
| 873 |
| 874 |
| 875 |
| 876 |
| 877 |
| 878 |
| 879 |
| 880 |
| 881 |
| 882 |
| 883 |
| 884 |
| 885 |
| 886 |
| 887 |
| 888 |
| 889 |
| 890 |
| 891 |
| 892 |
| 893 |
| 894 |
| 895 |
| 896 |
| 897 |
| 898 |
| 899 |
| 900 |
| 901 |

TABLE D1-continued

Gene modifying polypeptide candidates having a Z-score of at least 1 or greater in any one of conditions 1, 2, or 3.
SEQ ID NOs

| |
|---|
| 902 |
| 903 |
| 904 |
| 905 |
| 906 |
| 907 |
| 908 |
| 909 |
| 910 |
| 911 |
| 912 |
| 913 |
| 914 |
| 915 |
| 916 |
| 917 |
| 918 |
| 919 |
| 920 |
| 921 |
| 922 |
| 923 |
| 924 |
| 925 |
| 926 |
| 927 |
| 928 |
| 929 |
| 931 |
| 933 |
| 934 |
| 936 |
| 937 |
| 938 |
| 939 |
| 944 |
| 945 |
| 946 |
| 948 |
| 950 |
| 951 |
| 952 |
| 957 |
| 958 |
| 959 |
| 960 |
| 961 |
| 962 |
| 963 |
| 964 |
| 965 |
| 966 |
| 967 |
| 968 |
| 969 |
| 970 |
| 971 |
| 972 |
| 973 |
| 974 |
| 975 |
| 976 |
| 977 |
| 978 |
| 979 |
| 980 |
| 981 |
| 982 |
| 983 |
| 984 |
| 985 |
| 986 |
| 987 |

TABLE D1-continued

Gene modifying polypeptide
candidates having
a Z-score of at least 1
or greater in any one of
conditions 1, 2, or 3.
SEQ ID NOs 988
989
990
991
992
993
994
996
997
999
1000
1002
1003
1004
1005
1006
1007
1008
1009
1010
1011
1012
1013
1014
1015
1016
1017
1018
1019
1020
1021
1022
1023
1024
1025
1026
1027
1028
1029
1030
1031
1032
1033
1034
1035
1036
1037
1038
1039
1040
1041
1042
1043
1044
1045
1046
1047
1048
1049
1050
1051
1052
1053
1054
1055
1056
1057
1058
1059
1060
1061
1062
1063

TABLE D1-continued

Gene modifying polypeptide
candidates having
a Z-score of at least 1
or greater in any one of
conditions 1, 2, or 3.
SEQ ID NOs 1065
1066
1067
1068
1069
1070
1071
1072
1073
1074
1075
1076
1077
1078
1079
1080
1081
1082
1083
1084
1085
1086
1087
1088
1089
1090
1091
1092
1093
1094
1095
1097
1103
1115
1116
1117
1118
1120
1121
1123
1126
1131
1136
1137
1138
1139
1140
1141
1142
1143
1144
1145
1146
1147
1148
1149
1150
1151
1152
1153
1154
1155
1156
1157
1158
1159
1160
1161
1163
1164
1165
1166
1167

TABLE D1-continued

Gene modifying polypeptide candidates having a Z-score of at least 1 or greater in any one of conditions 1, 2, or 3.
SEQ ID NOs

| |
|---|
| 1168 |
| 1169 |
| 1170 |
| 1171 |
| 1172 |
| 1173 |
| 1174 |
| 1176 |
| 1177 |
| 1178 |
| 1179 |
| 1181 |
| 1184 |
| 1185 |
| 1186 |
| 1187 |
| 1190 |
| 1193 |
| 1197 |
| 1198 |
| 1199 |
| 1200 |
| 1201 |
| 1202 |
| 1203 |
| 1204 |
| 1205 |
| 1206 |
| 1207 |
| 1208 |
| 1209 |
| 1210 |
| 1211 |
| 1212 |
| 1213 |
| 1214 |
| 1215 |
| 1216 |
| 1217 |
| 1218 |
| 1219 |
| 1220 |
| 1221 |
| 1222 |
| 1223 |
| 1224 |
| 1225 |
| 1226 |
| 1227 |
| 1228 |
| 1229 |
| 1230 |
| 1231 |
| 1232 |
| 1233 |
| 1234 |
| 1235 |
| 1236 |
| 1237 |
| 1238 |
| 1239 |
| 1240 |
| 1241 |
| 1242 |
| 1243 |
| 1245 |
| 1246 |
| 1247 |
| 1248 |
| 1250 |
| 1251 |
| 1252 |
| 1253 |

TABLE D1-continued

Gene modifying polypeptide candidates having a Z-score of at least 1 or greater in any one of conditions 1, 2, or 3.
SEQ ID NOs

| |
|---|
| 1254 |
| 1255 |
| 1256 |
| 1257 |
| 1258 |
| 1259 |
| 1261 |
| 1262 |
| 1263 |
| 1264 |
| 1265 |
| 1266 |
| 1267 |
| 1269 |
| 1270 |
| 1272 |
| 1274 |
| 1275 |
| 1278 |
| 1279 |
| 1280 |
| 1282 |
| 1288 |
| 1290 |
| 1295 |
| 1298 |
| 1299 |
| 1301 |
| 1302 |
| 1305 |
| 1308 |
| 1311 |
| 1312 |
| 1314 |
| 1315 |
| 1320 |
| 1322 |
| 1324 |
| 1326 |
| 1327 |
| 1328 |
| 1338 |
| 1340 |
| 1342 |
| 1347 |
| 1348 |
| 1349 |
| 1350 |
| 1354 |
| 1359 |
| 1366 |
| 1369 |
| 1370 |
| 1371 |
| 1372 |
| 1373 |
| 1374 |
| 1375 |
| 1376 |
| 1377 |
| 1378 |
| 1379 |
| 1380 |
| 1381 |
| 1382 |
| 1383 |
| 1384 |
| 1385 |
| 1386 |
| 1387 |
| 1388 |
| 1389 |
| 1390 |

TABLE D1-continued

Gene modifying polypeptide candidates having a Z-score of at least 1 or greater in any one of conditions 1, 2, or 3. SEQ ID NOs 1391
1392
1393
1394
1395
1396
1397
1398
1399
1400
1401
1402
1403
1404
1405
1406
1407
1408
1409
1410
1411
1412
1413
1414
1415
1416
1417
1418
1419
1420
1421
1422
1423
1424
1425
1426
1427
1429
1430
1431
1432
1433
1434
1435
1436
1439
1440
1441
1442
1444
1446
1447
1449
1452
1455
1456
1460
1471
1497
1499
1504
1505
1506
1507
1508
1519
1521
1523
1527
1529
1539
1540
1541

TABLE D1-continued

Gene modifying polypeptide candidates having a Z-score of at least 1 or greater in any one of conditions 1, 2, or 3. SEQ ID NOs 1542
1543
1544
1545
1546
1547
1548
1549
1550
1551
1552
1553
1555
1556
1557
1558
1559
1561
1563
1564
1565
1566
1567
1568
1570
1571
1572
1573
1574
1576
1577
1578
1579
1580
1581
1582
1583
1585
1588
1590
1593
1594
1597
1598
1600
1604
1605
1606
1607
1608
1610
1611
1612
1616
1617
1618
1619
1620
1621
1622
1623
1625
1626
1627
1628
1629
1630
1631
1632
1633
1634
1635
1636

TABLE D1-continued

Gene modifying polypeptide candidates having a Z-score of at least 1 or greater in any one of conditions 1, 2, or 3.
SEQ ID NOs 1638
1639
1641
1642
1644
1645
1646
1647
1648
1649
1651
1653
1656
1657
1658
1659
1661
1662
1663
1664
1665
1666
1667
1668
1669
1670
1671
1672
1673
1674
1675
1676
1677
1678
1679
1680
1681
1682
1683
1684
1685
1686
1687
1688
1689
1690
1691
1693
1694
1695
1696
1697
1698
1699
1700
1701
1702
1703
1704
1705
1706
1707
1708
1709
1710
1711
1712
1713
1714
1715
1716
1717
1718

TABLE D1-continued

Gene modifying polypeptide candidates having a Z-score of at least 1 or greater in any one of conditions 1, 2, or 3.
SEQ ID NOs 1719
1720
1721
1722
1723
1725
1726
1729
1735
1736
1738
1739
1741
1742
1743
1747
1751
1752
1753
1754
1755
1756
1757
1758
1759
1760
1761
1762
1764
1765
1766
1767
1768
1769
1770
1771
1772
1773
1774
1775
1776
1777
1778
1779
1780
1781
1783
1784
1785
1786
1787
1788
1789
1790
1792
1793
1794
1795
1796
1799
1801
1802
1803
1804
1805
1806
1808
1809
1810
1811
1813
1816
1817

TABLE D1-continued

Gene modifying polypeptide candidates having a Z-score of at least 1 or greater in any one of conditions 1, 2, or 3. SEQ ID NOs

| SEQ ID NOs |
|---|
| 1818 |
| 1819 |
| 1824 |
| 1825 |
| 1827 |
| 1828 |
| 1829 |
| 1831 |
| 1834 |
| 1838 |
| 1840 |
| 1842 |
| 1843 |
| 1844 |
| 1845 |
| 1846 |
| 1847 |
| 1848 |
| 1849 |
| 1850 |
| 1851 |
| 1852 |
| 1853 |
| 1855 |
| 1856 |
| 1857 |
| 1858 |
| 1859 |
| 1860 |
| 1861 |
| 1862 |
| 1863 |
| 1864 |
| 1865 |
| 1866 |
| 1867 |
| 1868 |
| 1869 |
| 1870 |
| 1871 |
| 1872 |
| 1873 |
| 1874 |
| 1875 |
| 1876 |
| 1877 |
| 1878 |
| 1879 |
| 1880 |
| 1881 |
| 1882 |
| 1883 |
| 1884 |
| 1885 |
| 1886 |
| 1887 |
| 1888 |
| 1889 |
| 1890 |
| 1891 |
| 1892 |
| 1893 |
| 1894 |
| 1895 |
| 1896 |
| 1897 |
| 1898 |
| 1899 |
| 1900 |
| 1901 |
| 1902 |
| 1903 |
| 1905 |
| 1906 |
| 1907 |
| 1908 |
| 1909 |
| 1910 |
| 1911 |
| 1912 |
| 1913 |
| 1914 |
| 1915 |
| 1916 |
| 1917 |
| 1918 |
| 1920 |
| 1921 |
| 1922 |
| 1923 |
| 1924 |
| 1925 |
| 1926 |
| 1927 |
| 1929 |
| 1931 |
| 1932 |
| 1934 |
| 1935 |
| 1936 |
| 1937 |
| 1938 |
| 1939 |
| 1940 |
| 1941 |
| 1942 |
| 1943 |
| 1944 |
| 1945 |
| 1946 |
| 1947 |
| 1948 |
| 1949 |
| 1950 |
| 1951 |
| 1952 |
| 1953 |
| 1954 |
| 1955 |
| 1956 |
| 1957 |
| 1958 |
| 1959 |
| 1960 |
| 1961 |
| 1962 |
| 1963 |
| 1964 |
| 1965 |
| 1966 |
| 1967 |
| 1968 |
| 1969 |
| 1970 |
| 1971 |
| 1972 |
| 1973 |
| 1974 |
| 1975 |
| 1976 |
| 1977 |
| 1978 |
| 1979 |
| 1980 |
| 1981 |
| 1982 |

TABLE D1-continued

Gene modifying polypeptide
candidates having
a Z-score of at least 1
or greater in any one of
conditions 1, 2, or 3.
SEQ ID NOs

| |
|---|
| 1983 |
| 1984 |
| 1985 |
| 1986 |
| 1987 |
| 1988 |
| 1989 |
| 1990 |
| 1991 |
| 1992 |
| 1993 |
| 1994 |
| 1995 |
| 1996 |
| 1997 |
| 1998 |
| 1999 |
| 2000 |
| 2001 |
| 2002 |
| 2003 |
| 2004 |
| 2005 |
| 2006 |
| 2007 |
| 2008 |
| 2009 |
| 2011 |
| 2012 |
| 2013 |
| 2014 |
| 2015 |
| 2017 |
| 2018 |
| 2019 |
| 2020 |
| 2021 |
| 2022 |
| 2023 |
| 2024 |
| 2025 |
| 2027 |
| 2028 |
| 2029 |
| 2030 |
| 2031 |
| 2033 |
| 2034 |
| 2035 |
| 2037 |
| 2038 |
| 2039 |
| 2041 |
| 2042 |
| 2045 |
| 2048 |
| 2049 |
| 2050 |
| 2051 |
| 2052 |
| 2053 |
| 2054 |
| 2055 |
| 2056 |
| 2057 |
| 2058 |
| 2060 |
| 2061 |
| 2062 |
| 2069 |
| 2070 |
| 2071 |
| 2074 |
| 2075 |
| 2076 |
| 2081 |
| 2082 |
| 2084 |
| 2086 |
| 2089 |
| 2090 |
| 2091 |
| 2092 |
| 2093 |
| 2094 |
| 2095 |
| 2096 |
| 2103 |
| 2104 |
| 2105 |
| 2108 |
| 2111 |
| 2112 |
| 2113 |
| 2114 |
| 2115 |
| 2117 |
| 2121 |
| 2122 |
| 2123 |
| 2125 |
| 2126 |
| 2128 |
| 2130 |
| 2132 |
| 2136 |
| 2137 |
| 2138 |
| 2141 |
| 2143 |
| 2144 |
| 2145 |
| 2147 |
| 2148 |
| 2149 |
| 2150 |
| 2152 |
| 2153 |
| 2154 |
| 2155 |
| 2156 |
| 2158 |
| 2159 |
| 2161 |
| 2162 |
| 2163 |
| 2164 |
| 2165 |
| 2166 |
| 2167 |
| 2170 |
| 2172 |
| 2173 |
| 2174 |
| 2175 |
| 2176 |
| 2177 |
| 2178 |
| 2179 |
| 2182 |
| 2184 |
| 2185 |
| 2186 |
| 2191 |
| 2192 |
| 2193 |

TABLE D1-continued

Gene modifying polypeptide candidates having a Z-score of at least 1 or greater in any one of conditions 1, 2, or 3. SEQ ID NOs

| |
|---|
| 2195 |
| 2196 |
| 2197 |
| 2198 |
| 2201 |
| 2202 |
| 2205 |
| 2206 |
| 2207 |
| 2213 |
| 2214 |
| 2219 |
| 2224 |
| 2225 |
| 2226 |
| 2227 |
| 2228 |
| 2229 |
| 2230 |
| 2231 |
| 2232 |
| 2233 |
| 2234 |
| 2235 |
| 2236 |
| 2238 |
| 2239 |
| 2240 |
| 2241 |
| 2242 |
| 2244 |
| 2245 |
| 2246 |
| 2247 |
| 2248 |
| 2249 |
| 2250 |
| 2251 |
| 2252 |
| 2253 |
| 2254 |
| 2255 |
| 2256 |
| 2257 |
| 2259 |
| 2260 |
| 2261 |
| 2262 |
| 2263 |
| 2264 |
| 2265 |
| 2266 |
| 2268 |
| 2270 |
| 2271 |
| 2273 |
| 2275 |
| 2276 |
| 2277 |
| 2278 |
| 2279 |
| 2280 |
| 2282 |
| 2286 |
| 2287 |
| 2288 |
| 2291 |
| 2292 |
| 2294 |
| 2295 |
| 2299 |
| 2300 |
| 2301 |
| 2302 |
| 2303 |
| 2304 |
| 2305 |
| 2306 |
| 2307 |
| 2308 |
| 2309 |
| 2310 |
| 2311 |
| 2312 |
| 2313 |
| 2314 |
| 2315 |
| 2316 |
| 2317 |
| 2318 |
| 2319 |
| 2320 |
| 2321 |
| 2322 |
| 2323 |
| 2324 |
| 2325 |
| 2326 |
| 2327 |
| 2328 |
| 2329 |
| 2330 |
| 2331 |
| 2332 |
| 2333 |
| 2334 |
| 2335 |
| 2336 |
| 2337 |
| 2338 |
| 2339 |
| 2340 |
| 2341 |
| 2342 |
| 2343 |
| 2344 |
| 2345 |
| 2346 |
| 2347 |
| 2348 |
| 2349 |
| 2350 |
| 2351 |
| 2352 |
| 2353 |
| 2354 |
| 2355 |
| 2356 |
| 2357 |
| 2358 |
| 2359 |
| 2360 |
| 2361 |
| 2362 |
| 2363 |
| 2364 |
| 2365 |
| 2366 |
| 2367 |
| 2368 |
| 2369 |
| 2370 |
| 2371 |
| 2372 |
| 2373 |
| 2374 |

TABLE D1-continued

Gene modifying polypeptide candidates having a Z-score of at least 1 or greater in any one of conditions 1, 2, or 3.
SEQ ID NOs

| SEQ ID NOs |
|---|
| 2375 |
| 2376 |
| 2377 |
| 2378 |
| 2379 |
| 2380 |
| 2381 |
| 2382 |
| 2383 |
| 2384 |
| 2385 |
| 2386 |
| 2387 |
| 2388 |
| 2389 |
| 2390 |
| 2391 |
| 2392 |
| 2393 |
| 2394 |
| 2395 |
| 2396 |
| 2397 |
| 2398 |
| 2399 |
| 2400 |
| 2401 |
| 2402 |
| 2403 |
| 2404 |
| 2405 |
| 2406 |
| 2407 |
| 2408 |
| 2409 |
| 2410 |
| 2411 |
| 2413 |
| 2414 |
| 2417 |
| 2418 |
| 2422 |
| 2423 |
| 2425 |
| 2426 |
| 2431 |
| 2436 |
| 2438 |
| 2440 |
| 2441 |
| 2442 |
| 2443 |
| 2444 |
| 2445 |
| 2446 |
| 2447 |
| 2448 |
| 2449 |
| 2450 |
| 2451 |
| 2452 |
| 2453 |
| 2454 |
| 2455 |
| 2456 |
| 2457 |
| 2458 |
| 2459 |
| 2460 |
| 2461 |
| 2462 |
| 2463 |
| 2464 |
| 2465 |
| 2468 |
| 2469 |
| 2470 |
| 2471 |
| 2472 |
| 2474 |
| 2477 |
| 2478 |
| 2480 |
| 2488 |
| 2489 |
| 2490 |
| 2497 |
| 2498 |
| 2503 |
| 2504 |
| 2505 |
| 2506 |
| 2507 |
| 2508 |
| 2509 |
| 2510 |
| 2511 |
| 2512 |
| 2513 |
| 2514 |
| 2515 |
| 2516 |
| 2517 |
| 2518 |
| 2519 |
| 2520 |
| 2521 |
| 2522 |
| 2523 |
| 2524 |
| 2525 |
| 2526 |
| 2527 |
| 2528 |
| 2529 |
| 2530 |
| 2531 |
| 2532 |
| 2533 |
| 2534 |
| 2535 |
| 2536 |
| 2537 |
| 2538 |
| 2539 |
| 2540 |
| 2541 |
| 2542 |
| 2543 |
| 2544 |
| 2545 |
| 2546 |
| 2547 |
| 2548 |
| 2549 |
| 2550 |
| 2551 |
| 2552 |
| 2553 |
| 2554 |
| 2555 |
| 2556 |
| 2557 |
| 2558 |
| 2559 |
| 2560 |

TABLE D1-continued

Gene modifying polypeptide
candidates having
a Z-score of at least 1
or greater in any one of
conditions 1, 2, or 3.
SEQ ID NOs

| SEQ ID NOs |
|---|
| 2561 |
| 2562 |
| 2563 |
| 2564 |
| 2565 |
| 2566 |
| 2567 |
| 2568 |
| 2569 |
| 2570 |
| 2571 |
| 2572 |
| 2573 |
| 2574 |
| 2575 |
| 2576 |
| 2577 |
| 2578 |
| 2579 |
| 2580 |
| 2581 |
| 2582 |
| 2583 |
| 2584 |
| 2585 |
| 2586 |
| 2587 |
| 2588 |
| 2589 |
| 2590 |
| 2591 |
| 2592 |
| 2593 |
| 2594 |
| 2595 |
| 2596 |
| 2597 |
| 2598 |
| 2599 |
| 2600 |
| 2601 |
| 2603 |
| 2604 |
| 2605 |
| 2606 |
| 2608 |
| 2610 |
| 2611 |
| 2612 |
| 2613 |
| 2614 |
| 2615 |
| 2616 |
| 2617 |
| 2618 |
| 2619 |
| 2620 |
| 2621 |
| 2622 |
| 2623 |
| 2624 |
| 2625 |
| 2626 |
| 2627 |
| 2628 |
| 2629 |
| 2630 |
| 2631 |
| 2632 |
| 2633 |
| 2634 |
| 2635 |
| 2636 |

TABLE D1-continued

Gene modifying polypeptide
candidates having
a Z-score of at least 1
or greater in any one of
conditions 1, 2, or 3.
SEQ ID NOs

| SEQ ID NOs |
|---|
| 2637 |
| 2638 |
| 2639 |
| 2640 |
| 2641 |
| 2642 |
| 2643 |
| 2644 |
| 2645 |
| 2646 |
| 2647 |
| 2648 |
| 2649 |
| 2650 |
| 2651 |
| 2652 |
| 2653 |
| 2654 |
| 2656 |
| 2657 |
| 2658 |
| 2659 |
| 2660 |
| 2661 |
| 2662 |
| 2663 |
| 2664 |
| 2665 |
| 2666 |
| 2667 |
| 2668 |
| 2669 |
| 2670 |
| 2671 |
| 2672 |
| 2673 |
| 2674 |
| 2675 |
| 2676 |
| 2677 |
| 2679 |
| 2680 |
| 2681 |
| 2682 |
| 2683 |
| 2684 |
| 2685 |
| 2687 |
| 2688 |
| 2689 |
| 2690 |
| 2692 |
| 2693 |
| 2695 |
| 2696 |
| 2697 |
| 2700 |
| 2701 |
| 2702 |
| 2703 |
| 2706 |
| 2708 |
| 2709 |
| 2710 |
| 2711 |
| 2712 |
| 2713 |
| 2714 |
| 2715 |
| 2716 |
| 2717 |
| 2718 |
| 2719 |

TABLE D1-continued

Gene modifying polypeptide
candidates having
a Z-score of at least 1
or greater in any one of
conditions 1, 2, or 3.
SEQ ID NOs

| |
|---|
| 2720 |
| 2721 |
| 2722 |
| 2723 |
| 2724 |
| 2725 |
| 2726 |
| 2727 |
| 2728 |
| 2729 |
| 2730 |
| 2731 |
| 2732 |
| 2733 |
| 2734 |
| 2735 |
| 2736 |
| 2737 |
| 2738 |
| 2739 |
| 2740 |
| 2741 |
| 2742 |
| 2743 |
| 2744 |
| 2745 |
| 2746 |
| 2747 |
| 2748 |
| 2749 |
| 2750 |
| 2751 |
| 2752 |
| 2755 |
| 2756 |
| 2757 |
| 2758 |
| 2760 |
| 2761 |
| 2762 |
| 2764 |
| 2765 |
| 2766 |
| 2767 |
| 2768 |
| 2769 |
| 2772 |
| 2773 |
| 2774 |
| 2775 |
| 2776 |
| 2777 |
| 2778 |
| 2779 |
| 2780 |
| 2781 |
| 2782 |
| 2783 |
| 2784 |
| 2785 |
| 2786 |
| 2787 |
| 2788 |
| 2789 |
| 2790 |
| 2791 |
| 2792 |
| 2793 |
| 2794 |
| 2795 |
| 2796 |
| 2797 |
| 2798 |

TABLE D1-continued

Gene modifying polypeptide
candidates having
a Z-score of at least 1
or greater in any one of
conditions 1, 2, or 3.
SEQ ID NOs

| |
|---|
| 2799 |
| 2800 |
| 2801 |
| 2802 |
| 2803 |
| 2804 |
| 2805 |
| 2806 |
| 2807 |
| 2808 |
| 2809 |
| 2810 |
| 2811 |
| 2812 |
| 2813 |
| 2814 |
| 2815 |
| 2816 |
| 2817 |
| 2818 |
| 2819 |
| 2820 |
| 2821 |
| 2822 |
| 2823 |
| 2824 |
| 2825 |
| 2826 |
| 2827 |
| 2828 |
| 2829 |
| 2830 |
| 2831 |
| 2832 |
| 2833 |
| 2834 |
| 2835 |
| 2836 |
| 2837 |
| 2838 |
| 2839 |
| 2840 |
| 2841 |
| 2842 |
| 2843 |
| 2844 |
| 2845 |
| 2846 |
| 2847 |
| 2848 |
| 2849 |
| 2850 |
| 2851 |
| 2852 |
| 2853 |
| 2854 |
| 2855 |
| 2856 |
| 2857 |
| 2858 |
| 2859 |
| 2860 |
| 2861 |
| 2862 |
| 2865 |
| 2866 |
| 2867 |
| 2868 |
| 2869 |
| 2870 |
| 2871 |
| 2872 |
| 2873 |

TABLE D1-continued

Gene modifying polypeptide candidates having a Z-score of at least 1 or greater in any one of conditions 1, 2, or 3.
SEQ ID NOs

| SEQ ID NOs |
|---|
| 2874 |
| 2875 |
| 2877 |
| 2878 |
| 2879 |
| 2881 |
| 2882 |
| 2884 |
| 2885 |
| 2886 |
| 2887 |
| 2888 |
| 2889 |
| 2890 |
| 2891 |
| 2892 |
| 2893 |
| 2894 |
| 2895 |
| 2896 |
| 2897 |
| 2898 |
| 2900 |
| 2901 |
| 2902 |
| 2903 |
| 2904 |
| 2905 |
| 2906 |
| 2907 |
| 2908 |
| 2909 |
| 2910 |
| 2911 |
| 2912 |
| 2913 |
| 2914 |
| 2915 |
| 2916 |
| 2917 |
| 2918 |
| 2919 |
| 2920 |
| 2921 |
| 2922 |
| 2923 |
| 2925 |
| 2926 |
| 2927 |
| 2928 |
| 2929 |
| 2930 |
| 2931 |
| 2932 |
| 2933 |
| 2934 |
| 2935 |
| 2936 |
| 2937 |
| 2938 |
| 2939 |
| 2940 |
| 2941 |
| 2942 |
| 2943 |
| 2945 |
| 2947 |
| 2948 |
| 2950 |
| 2951 |
| 2953 |
| 2954 |
| 2955 |

TABLE D1-continued

Gene modifying polypeptide candidates having a Z-score of at least 1 or greater in any one of conditions 1, 2, or 3.
SEQ ID NOs

| SEQ ID NOs |
|---|
| 2957 |
| 2959 |
| 2960 |
| 2962 |
| 2965 |
| 2966 |
| 2967 |
| 2970 |
| 2971 |
| 2972 |
| 2973 |
| 2974 |
| 2975 |
| 2976 |
| 2977 |
| 2979 |
| 2980 |
| 2981 |
| 2982 |
| 2983 |
| 2984 |
| 2985 |
| 2986 |
| 2987 |
| 2988 |
| 2989 |
| 2990 |
| 2991 |
| 2992 |
| 2993 |
| 2994 |
| 2995 |
| 2997 |
| 2998 |
| 2999 |
| 3001 |
| 3002 |
| 3003 |
| 3005 |
| 3007 |
| 3008 |
| 3009 |
| 3010 |
| 3011 |
| 3012 |
| 3014 |
| 3015 |
| 3016 |
| 3017 |
| 3018 |
| 3019 |
| 3020 |
| 3021 |
| 3022 |
| 3025 |
| 3026 |
| 3027 |
| 3028 |
| 3030 |
| 3031 |
| 3033 |
| 3034 |
| 3035 |
| 3036 |
| 3037 |
| 3038 |
| 3039 |
| 3040 |
| 3041 |
| 3042 |
| 3043 |
| 3044 |
| 3045 |

TABLE D1-continued

Gene modifying polypeptide
candidates having
a Z-score of at least 1
or greater in any one of
conditions 1, 2, or 3.
SEQ ID NOs

| |
|---|
| 3046 |
| 3047 |
| 3048 |
| 3049 |
| 3050 |
| 3051 |
| 3052 |
| 3053 |
| 3054 |
| 3055 |
| 3056 |
| 3057 |
| 3058 |
| 3059 |
| 3060 |
| 3061 |
| 3062 |
| 3063 |
| 3064 |
| 3065 |
| 3066 |
| 3067 |
| 3070 |
| 3071 |
| 3072 |
| 3073 |
| 3074 |
| 3075 |
| 3076 |
| 3077 |
| 3078 |
| 3079 |
| 3080 |
| 3081 |
| 3082 |
| 3083 |
| 3084 |
| 3085 |
| 3086 |
| 3087 |
| 3088 |
| 3089 |
| 3090 |
| 3091 |
| 3092 |
| 3093 |
| 3094 |
| 3096 |
| 3097 |
| 3098 |
| 3099 |
| 3101 |
| 3102 |
| 3103 |
| 3104 |
| 3107 |
| 3108 |
| 3109 |
| 3110 |
| 3111 |
| 3112 |
| 3113 |
| 3114 |
| 3115 |
| 3116 |
| 3117 |
| 3118 |
| 3119 |
| 3120 |
| 3121 |
| 3122 |
| 3123 |
| 3124 |

TABLE D1-continued

Gene modifying polypeptide
candidates having
a Z-score of at least 1
or greater in any one of
conditions 1, 2, or 3.
SEQ ID NOs

| |
|---|
| 3125 |
| 3126 |
| 3127 |
| 3128 |
| 3129 |
| 3130 |
| 3131 |
| 3133 |
| 3134 |
| 3135 |
| 3136 |
| 3138 |
| 3139 |
| 3144 |
| 3146 |
| 3149 |
| 3152 |
| 3154 |
| 3155 |
| 3157 |
| 3167 |
| 3169 |
| 3171 |
| 3172 |
| 3173 |
| 3176 |
| 3177 |
| 3180 |
| 3181 |
| 3184 |
| 3190 |
| 3196 |
| 3198 |
| 3199 |
| 3208 |
| 3214 |
| 3233 |
| 3247 |
| 3248 |
| 3251 |
| 3252 |
| 3253 |
| 3254 |
| 3256 |
| 3259 |
| 3260 |
| 3261 |
| 3262 |
| 3263 |
| 3264 |
| 3266 |
| 3268 |
| 3269 |
| 3270 |
| 3272 |
| 3277 |
| 3286 |
| 3302 |
| 3303 |
| 3305 |
| 3310 |
| 3313 |
| 3315 |
| 3316 |
| 3326 |
| 3329 |
| 4501 |
| 4502 |
| 4503 |
| 4505 |
| 4506 |
| 4507 |
| 4508 |

TABLE D1-continued

Gene modifying polypeptide candidates having a Z-score of at least 1 or greater in any one of conditions 1, 2, or 3.
SEQ ID NOs

| SEQ ID NOs |
|---|
| 4509 |
| 4510 |
| 4511 |
| 4512 |
| 4513 |
| 4514 |
| 4515 |
| 4516 |
| 4517 |
| 4518 |
| 4519 |
| 4520 |
| 4521 |
| 4522 |
| 4523 |
| 4524 |
| 4525 |
| 4526 |
| 4527 |
| 4528 |
| 4529 |
| 4530 |
| 4531 |
| 4532 |
| 4533 |
| 4534 |
| 4535 |
| 4536 |
| 4537 |
| 4538 |
| 4539 |
| 4540 |
| 4541 |
| 6001 |
| 6004 |
| 6007 |
| 6008 |
| 6012 |
| 6013 |
| 6014 |
| 6015 |
| 6021 |
| 6022 |
| 6023 |
| 6024 |
| 6025 |
| 6026 |
| 6028 |
| 6029 |
| 6030 |
| 6031 |
| 6036 |
| 6043 |
| 6045 |
| 6048 |
| 6051 |
| 6054 |
| 6056 |
| 6057 |
| 6058 |
| 6059 |
| 6061 |
| 6063 |
| 6067 |
| 6068 |
| 6071 |
| 6072 |
| 6073 |
| 6074 |
| 6079 |
| 6080 |
| 6084 |
| 6089 |
| 6091 |
| 6093 |
| 6094 |
| 6096 |
| 6099 |
| 6103 |
| 6106 |
| 6107 |
| 6108 |
| 6112 |
| 6115 |
| 6117 |
| 6121 |
| 6123 |
| 6130 |
| 6133 |
| 6136 |
| 6139 |
| 6142 |
| 6144 |
| 6147 |
| 6148 |
| 6150 |
| 6151 |
| 6152 |
| 6155 |
| 6163 |
| 6165 |
| 6168 |
| 6171 |
| 6172 |
| 6176 |
| 6180 |
| 6185 |
| 6188 |
| 6190 |
| 6191 |
| 6193 |
| 6196 |
| 6197 |
| 6201 |
| 6204 |
| 6205 |
| 6207 |
| 6208 |
| 6211 |
| 6216 |
| 6218 |
| 6219 |
| 6223 |
| 6227 |
| 6234 |
| 6236 |
| 6240 |
| 6243 |
| 6244 |
| 6247 |
| 6248 |
| 6250 |
| 6253 |
| 6254 |
| 6257 |
| 6258 |
| 6263 |
| 6264 |
| 6265 |
| 6266 |
| 6267 |
| 6268 |
| 6269 |
| 6271 |
| 6272 |
| 6273 |

TABLE D1-continued

Gene modifying polypeptide candidates having a Z-score of at least 1 or greater in any one of conditions 1, 2, or 3.
SEQ ID NOs

| |
|---|
| 6275 |
| 6278 |
| 6281 |
| 6284 |
| 6285 |
| 6286 |
| 6287 |
| 6289 |
| 6290 |
| 6292 |
| 6293 |
| 6294 |
| 6300 |
| 6304 |
| 6305 |
| 6307 |
| 6309 |
| 6310 |
| 6311 |
| 6312 |
| 6313 |
| 6317 |
| 6318 |
| 6322 |
| 6323 |
| 6324 |
| 6325 |
| 6327 |
| 6328 |
| 6329 |
| 6339 |
| 6340 |
| 6343 |
| 6344 |
| 6346 |
| 6349 |
| 6351 |
| 6356 |
| 6363 |
| 6364 |
| 6367 |
| 6370 |
| 6377 |
| 6378 |
| 6381 |
| 6384 |
| 6387 |
| 6389 |
| 6394 |
| 6395 |
| 6402 |
| 6403 |
| 6407 |
| 6409 |
| 6410 |
| 6412 |
| 6415 |
| 6417 |
| 6418 |
| 6419 |
| 6421 |
| 6423 |
| 6424 |
| 6425 |
| 6426 |
| 6427 |
| 6429 |
| 6432 |
| 6434 |
| 6439 |
| 6442 |
| 6443 |
| 6444 |

TABLE D1-continued

Gene modifying polypeptide candidates having a Z-score of at least 1 or greater in any one of conditions 1, 2, or 3.
SEQ ID NOs

| |
|---|
| 6445 |
| 6449 |
| 6453 |
| 6454 |
| 6457 |
| 6458 |
| 6462 |
| 6465 |
| 6478 |
| 6479 |
| 6480 |
| 6486 |
| 6488 |
| 6491 |
| 6492 |
| 6495 |
| 6497 |
| 6499 |
| 6501 |
| 6502 |
| 6503 |
| 6505 |
| 6511 |
| 6512 |
| 6515 |
| 6520 |
| 6524 |
| 6525 |
| 6527 |
| 6529 |
| 6530 |
| 6531 |
| 6532 |
| 6533 |
| 6535 |
| 6540 |
| 6542 |
| 6549 |
| 6551 |
| 6552 |
| 6555 |
| 6558 |
| 6559 |
| 6561 |
| 6563 |
| 6565 |
| 6567 |
| 6568 |
| 6572 |
| 6575 |
| 6577 |
| 6578 |
| 6579 |
| 6580 |
| 6581 |
| 6582 |
| 6583 |
| 6584 |
| 6585 |
| 6587 |
| 6591 |
| 6594 |
| 6595 |
| 6596 |
| 6598 |
| 6600 |
| 6601 |
| 6602 |
| 6603 |
| 6606 |
| 6607 |
| 6608 |
| 6610 |

TABLE D1-continued

Gene modifying polypeptide candidates having a Z-score of at least 1 or greater in any one of conditions 1, 2, or 3.
SEQ ID NOs 6611
6612
6615
6616
6617
6621
6622
6624
6627
6630
6635
6639
6642
6644
6645
6646
6648
6650
6651
6652
6654
6655
6656
6659
6665
6666
6668
6671
6672
6674
6675
6676
6680
6681
6683
6684
6685
6686
6688
6690
6692
6693
6695
6698
6705
6706
6708
6709
6710
6713
6715
6716
6717
6718
6719
6724
6726
6728
6730
6731
6732
6733
6736
6738
6744
6746
6751
6754
6756
6757
6758
6760
6761

TABLE D1-continued

Gene modifying polypeptide candidates having a Z-score of at least 1 or greater in any one of conditions 1, 2, or 3.
SEQ ID NOs 6762
6765
6770
6772
6773
6776
6777
6778
6783
6784
6785
6786
6788
6793
6794
6795
6796
6797
6798
6801
6802
6808
6809
6811
6815
6816
6823
6826
6827
6832
6834
6841
6842
6845
6850
6852
6855
6859
6861
6864
6866
6870
6872
6873
6874
6876
6877
6878
6879
6881
6882
6883
6884
6885
6886
6887
6890
6891
6896
6897
6898
6901
6902
6904
6905
6907
6908
6910
6911
6915
6917
6919
6923

TABLE D1-continued

Gene modifying polypeptide candidates having a Z-score of at least 1 or greater in any one of conditions 1, 2, or 3.
SEQ ID NOs

| |
|---|
| 6925 |
| 6928 |
| 6930 |
| 6932 |
| 6933 |
| 6942 |
| 6943 |
| 6951 |
| 6952 |
| 6963 |
| 6966 |
| 6968 |
| 6969 |
| 6972 |
| 6978 |
| 6980 |
| 6982 |
| 6984 |
| 6990 |
| 6993 |
| 6998 |
| 6999 |
| 7001 |
| 7006 |
| 7009 |
| 7013 |
| 7015 |
| 7023 |
| 7024 |
| 7025 |
| 7026 |
| 7027 |
| 7030 |
| 7031 |
| 7033 |
| 7034 |
| 7035 |
| 7036 |
| 7037 |
| 7038 |
| 7043 |
| 7045 |
| 7046 |
| 7047 |
| 7048 |
| 7051 |
| 7055 |
| 7056 |
| 7058 |
| 7060 |
| 7064 |
| 7065 |
| 7067 |
| 7068 |
| 7070 |
| 7071 |
| 7072 |
| 7074 |
| 7075 |
| 7077 |
| 7078 |
| 7079 |
| 7080 |
| 7081 |
| 7082 |
| 7085 |
| 7087 |
| 7088 |
| 7089 |
| 7091 |
| 7096 |
| 7098 |
| 7100 |
| 7103 |
| 7105 |
| 7110 |
| 7115 |
| 7116 |
| 7120 |
| 7121 |
| 7122 |
| 7123 |
| 7125 |
| 7127 |
| 7128 |
| 7129 |
| 7131 |
| 7135 |
| 7136 |
| 7138 |
| 7140 |
| 7141 |
| 7142 |
| 7143 |
| 7144 |
| 7147 |
| 7148 |
| 7150 |
| 7151 |
| 7153 |
| 7154 |
| 7157 |
| 7158 |
| 7160 |
| 7163 |
| 7164 |
| 7167 |
| 7169 |
| 7170 |
| 7171 |
| 7172 |
| 7174 |
| 7175 |
| 7176 |
| 7180 |
| 7181 |
| 7184 |
| 7186 |
| 7187 |
| 7188 |
| 7189 |
| 7191 |
| 7192 |
| 7193 |
| 7194 |
| 7197 |
| 7198 |
| 7203 |
| 7204 |
| 7205 |
| 7206 |
| 7207 |
| 7209 |
| 7214 |
| 7215 |
| 7216 |
| 7217 |
| 7218 |
| 7222 |
| 7226 |
| 7227 |
| 7228 |
| 7240 |
| 7242 |
| 7243 |
| 7244 |

TABLE D1-continued

Gene modifying polypeptide candidates having a Z-score of at least 1 or greater in any one of conditions 1, 2, or 3. SEQ ID NOs

| |
|---|
| 7246 |
| 7247 |
| 7250 |
| 7251 |
| 7252 |
| 7253 |
| 7255 |
| 7258 |
| 7261 |
| 7262 |
| 7263 |
| 7264 |
| 7267 |
| 7273 |
| 7274 |
| 7275 |
| 7276 |
| 7280 |
| 7281 |
| 7282 |
| 7284 |
| 7286 |
| 7288 |
| 7290 |
| 7291 |
| 7292 |
| 7293 |
| 7294 |
| 7296 |
| 7298 |
| 7299 |
| 7301 |
| 7302 |
| 7305 |
| 7306 |
| 7307 |
| 7311 |
| 7312 |
| 7313 |
| 7314 |
| 7317 |
| 7320 |
| 7322 |
| 7323 |
| 7326 |
| 7328 |
| 7329 |
| 7335 |
| 7336 |
| 7339 |
| 7342 |
| 7343 |
| 7345 |
| 7346 |
| 7347 |
| 7349 |
| 7350 |
| 7352 |
| 7357 |
| 7358 |
| 7360 |
| 7361 |
| 7362 |
| 7364 |
| 7368 |
| 7369 |
| 7370 |
| 7371 |
| 7372 |
| 7374 |
| 7377 |
| 7378 |
| 7381 |
| 7383 |
| 7384 |
| 7387 |
| 7388 |
| 7389 |
| 7393 |
| 7394 |
| 7396 |
| 7397 |
| 7402 |
| 7403 |
| 7404 |
| 7412 |
| 7415 |
| 7416 |
| 7417 |
| 7418 |
| 7419 |
| 7430 |
| 7431 |
| 7433 |
| 7434 |
| 7435 |
| 7436 |
| 7441 |
| 7443 |
| 7444 |
| 7445 |
| 7448 |
| 7449 |
| 7450 |
| 7453 |
| 7455 |
| 7458 |
| 7461 |
| 7466 |
| 7469 |
| 7471 |
| 7472 |
| 7473 |
| 7474 |
| 7476 |
| 7488 |
| 7489 |
| 7496 |
| 7497 |
| 7499 |
| 7500 |
| 7501 |
| 7508 |
| 7509 |
| 7511 |
| 7515 |
| 7519 |
| 7520 |
| 7523 |
| 7525 |
| 7526 |
| 7527 |
| 7530 |
| 7531 |
| 7536 |
| 7537 |
| 7538 |
| 7539 |
| 7540 |
| 7541 |
| 7543 |
| 7545 |
| 7547 |
| 7549 |
| 7550 |
| 7555 |

TABLE D1-continued

Gene modifying polypeptide
candidates having
a Z-score of at least 1
or greater in any one of
conditions 1, 2, or 3.
SEQ ID NOs 7556
7558
7565
7566
7567
7568
7569
7570
7574
7576
7578
7580
7582
7585
7587
7588
7589
7590
7591
7593
7594
7597
7599
7600
7606
7607
7610
7612
7613
7615
7617
7621
7625
7629
7632
7633
7634
7635
7636
7638
7644
7646
7649
7650
7651
7652
7653
7654
7656
7657
7658
7659
7660
7662
7663
7665
7667
7668
7670
7674
7675
7676
7677
7679
7681
7682
7685
7694
7695
7698
7702
7706
7707
7714
7717
7719
7723
7724
7728

A further analysis identified a subset of approximately 320 gene modifying polypeptide candidates having a Z-score of at least 1 or greater across all of conditions 1, 2, and 3. These results show that this subset of gene modifying polypeptides had editing activity in all analyzed conditions of the screening assay (FIG. 14, magenta colored dots). These include gene modifying polypeptides having amino acid sequences according to any one of the SEQ ID NOs listed in Table D2 below.

TABLE D2

Gene modifying polypeptide
candidates having
a Z-score of at least 1
or greater across all of
conditions 1, 2, and 3.
SEQ ID NOs 34
35
36
37
38
39
40
41
49
62
97
113
117
121
139
140
141
142
190
191
192
195
199
212
213
228
232
239
268
303
313
316
318
332
341
363
396
480
550
590
647
715
800
801

TABLE D2-continued

Gene modifying polypeptide candidates having a Z-score of at least 1 or greater across all of conditions 1, 2, and 3.
SEQ ID NOs

| |
|---|
| 804 |
| 806 |
| 871 |
| 872 |
| 873 |
| 874 |
| 878 |
| 882 |
| 883 |
| 884 |
| 890 |
| 900 |
| 901 |
| 912 |
| 958 |
| 960 |
| 963 |
| 964 |
| 966 |
| 987 |
| 1006 |
| 1007 |
| 1008 |
| 1012 |
| 1015 |
| 1016 |
| 1017 |
| 1018 |
| 1019 |
| 1020 |
| 1022 |
| 1023 |
| 1025 |
| 1038 |
| 1049 |
| 1059 |
| 1137 |
| 1168 |
| 1171 |
| 1197 |
| 1198 |
| 1202 |
| 1203 |
| 1216 |
| 1219 |
| 1225 |
| 1235 |
| 1242 |
| 1371 |
| 1372 |
| 1373 |
| 1374 |
| 1375 |
| 1376 |
| 1377 |
| 1380 |
| 1381 |
| 1382 |
| 1383 |
| 1384 |
| 1385 |
| 1389 |
| 1390 |
| 1394 |
| 1397 |
| 1400 |
| 1401 |
| 1404 |
| 1405 |
| 1406 |
| 1410 |
| 1540 |
| 1543 |
| 1550 |
| 1616 |
| 1618 |
| 1619 |
| 1666 |
| 1668 |
| 1672 |
| 1677 |
| 1679 |
| 1682 |
| 1686 |
| 1754 |
| 1759 |
| 1770 |
| 1856 |
| 1857 |
| 1861 |
| 1863 |
| 1864 |
| 1865 |
| 1868 |
| 1870 |
| 1877 |
| 1883 |
| 1889 |
| 1937 |
| 1938 |
| 1940 |
| 1942 |
| 1943 |
| 1945 |
| 1953 |
| 1961 |
| 1970 |
| 1976 |
| 1992 |
| 2048 |
| 2086 |
| 2091 |
| 2093 |
| 2115 |
| 2144 |
| 2158 |
| 2192 |
| 2225 |
| 2227 |
| 2231 |
| 2299 |
| 2300 |
| 2301 |
| 2302 |
| 2303 |
| 2304 |
| 2305 |
| 2308 |
| 2309 |
| 2311 |
| 2312 |
| 2314 |
| 2315 |
| 2316 |
| 2317 |
| 2319 |
| 2322 |
| 2323 |
| 2325 |
| 2326 |
| 2327 |
| 2328 |
| 2329 |
| 2331 |
| 2335 |
| 2338 |

TABLE D2-continued

Gene modifying polypeptide candidates having a Z-score of at least 1 or greater across all of conditions 1, 2, and 3.
SEQ ID NOs 2342
2346
2353
2363
2364
2365
2370
2371
2449
2503
2504
2505
2506
2507
2508
2510
2511
2512
2513
2514
2515
2518
2519
2521
2525
2526
2527
2528
2530
2534
2536
2542
2544
2548
2559
2568
2610
2611
2612
2614
2615
2618
2619
2622
2623
2624
2627
2629
2632
2633
2636
2638
2644
2648
2653
2711
2712
2713
2714
2715
2718
2721
2726
2734
2780
2781
2782
2783
2784
2787
2788
2789
2790
2792
2794
2795
2797
2798
2800
2801
2802
2804
2813
2817
2818
2826
2835
2865
2874
2877
2886
2888
2890
2895
2901
2904
2920
2932
2937
2943
2950
2966
2972
2982
3014
3015
3018
3026
3035
3039
3042
3053
3059
3067
3076
3079
3084
3091
3093
3094
3096
3108
3111
3112
3116
3120
3125
3126
3130

Additional sequencing data were generated for same DNA libraries for the test template g10 condition in HEK293T cells (condition 3) to improve detection sensitivity and confidence in evidence of genome editing activity. This further analysis including the revised dataset for condition 3 identified a subset of approximately 420 gene modifying polypeptide candidates having a Z score of at least 1 or greater across all of conditions 1, 2, and 3. These results show that this subset of gene modifying polypeptides had editing activity in all conditions of the screening assay under this revised analysis. These include gene modifying polypeptides having amino acid sequences according to any one of the SEQ ID NOs listed in Table D3 below.

TABLE D3

Gene modifying polypeptide candidates having a Z-score of at least 1 or greater across all of conditions 1, 2, or 3.
SEQ ID NOs:

34
35
36
37
38
39
48
49
62
97
113
121
123
139
140
142
144
147
190
191
192
195
213
219
232
239
252
258
268
303
316
318
320
332
363
384
386
392
396
480
550
590
647
715
800
801
804
805
806
818
819
871
872
873
874
876
878
880
883
884
890
898
900
901
912
915
929
958
960
961
963
964
966
967

TABLE D3-continued

Gene modifying polypeptide candidates having a Z-score of at least 1 or greater across all of conditions 1, 2, or 3.
SEQ ID NOs:

978
1006
1007
1008
1012
1015
1016
1017
1018
1019
1020
1022
1023
1025
1029
1038
1043
1049
1052
1059
1061
1115
1137
1168
1171
1197
1198
1202
1203
1210
1216
1219
1225
1235
1242
1371
1373
1374
1375
1376
1377
1380
1381
1382
1383
1384
1385
1389
1390
1394
1397
1399
1400
1401
1402
1405
1406
1410
1415
1419
1422
1424
1543
1550
1616
1618
1619
1666
1672
1679
1682
1686
1690
1691

TABLE D3-continued

Gene modifying polypeptide candidates having a Z-score of at least 1 or greater across all of conditions 1, 2, or 3.
SEQ ID NOs:

| |
|---|
| 1695 |
| 1698 |
| 1721 |
| 1754 |
| 1759 |
| 1769 |
| 1770 |
| 1772 |
| 1773 |
| 1856 |
| 1857 |
| 1861 |
| 1863 |
| 1864 |
| 1865 |
| 1868 |
| 1870 |
| 1874 |
| 1877 |
| 1881 |
| 1883 |
| 1889 |
| 1899 |
| 1937 |
| 1938 |
| 1939 |
| 1940 |
| 1942 |
| 1943 |
| 1945 |
| 1953 |
| 1961 |
| 1968 |
| 1970 |
| 1976 |
| 1978 |
| 1991 |
| 1992 |
| 2048 |
| 2086 |
| 2091 |
| 2092 |
| 2093 |
| 2115 |
| 2137 |
| 2144 |
| 2148 |
| 2158 |
| 2172 |
| 2174 |
| 2192 |
| 2225 |
| 2226 |
| 2227 |
| 2231 |
| 2235 |
| 2236 |
| 2299 |
| 2300 |
| 2301 |
| 2302 |
| 2303 |
| 2304 |
| 2305 |
| 2308 |
| 2309 |
| 2311 |
| 2312 |
| 2314 |
| 2315 |
| 2316 |
| 2317 |
| 2319 |
| 2322 |
| 2323 |
| 2325 |
| 2326 |
| 2327 |
| 2328 |
| 2329 |
| 2331 |
| 2335 |
| 2338 |
| 2342 |
| 2347 |
| 2353 |
| 2363 |
| 2364 |
| 2365 |
| 2370 |
| 2371 |
| 2382 |
| 2395 |
| 2403 |
| 2449 |
| 2503 |
| 2504 |
| 2505 |
| 2506 |
| 2507 |
| 2508 |
| 2510 |
| 2511 |
| 2512 |
| 2513 |
| 2514 |
| 2515 |
| 2518 |
| 2519 |
| 2521 |
| 2525 |
| 2526 |
| 2527 |
| 2528 |
| 2530 |
| 2531 |
| 2534 |
| 2536 |
| 2542 |
| 2544 |
| 2547 |
| 2548 |
| 2551 |
| 2556 |
| 2559 |
| 2561 |
| 2562 |
| 2566 |
| 2568 |
| 2578 |
| 2585 |
| 2592 |
| 2610 |
| 2611 |
| 2612 |
| 2614 |
| 2615 |
| 2618 |
| 2619 |
| 2622 |
| 2623 |
| 2624 |
| 2627 |
| 2629 |
| 2632 |
| 2633 |
| 2636 |
| 2638 |

TABLE D3-continued

Gene modifying polypeptide candidates having a Z-score of at least 1 or greater across all of conditions 1, 2, or 3.
SEQ ID NOs:

2639
2644
2647
2648
2649
2653
2654
2666
2667
2675
2676
2681
2711
2712
2713
2714
2715
2716
2718
2721
2723
2726
2731
2734
2744
2745
2780
2781
2782
2783
2784
2787
2788
2789
2790
2791
2792
2794
2795
2797
2798
2800
2801
2802
2804
2808
2813
2817
2818
2822
2826
2833
2835
2838
2840
2865
2871
2874
2877
2878
2886
2887
2888
2890
2895
2901
2904
2905
2909
2920
2922
2928
2932
2937

TABLE D3-continued

Gene modifying polypeptide candidates having a Z-score of at least 1 or greater across all of conditions 1, 2, or 3.
SEQ ID NOs:

2943
2948
2950
2966
2967
2972
2976
2982
2991
3014
3015
3018
3026
3035
3039
3042
3052
3053
3059
3067
3076
3079
3084
3087
3091
3093
3094
3096
3108
3111
3112
3116
3120
3121
3124
3125
3126
3130
3136
4505
4508
4514
4519
4521
4522
4532
6312
6505
6761
6925
7036
7067
7397

Approximately 3680 gene modifying polypeptide candidates within the library had a Z-score of at least 1 or greater in any one of conditions 1, 2, or 3 using this further analysis. These results show that this subset of gene modifying polypeptides had editing activity in at least one analyzed condition of the screening assay under this revised analysis. The subset of these gene modifying polypeptides are encoded by amino acid sequences of any one of the SEQ ID NOs listed in Table D4 below.

TABLE D4

Gene modifying polypeptide candidates having a Z-score of at least 1 or greater in any one of conditions 1, 2, or 3 according to the above further analysis.
SEQ ID NOs:

1
2
3
4
5
6
7
9
10
12
13
14
17
18
19
22
24
28
33
34
35
36
37
38
39
40
41
42
43
44
45
46
47
48
49
50
51
52
53
54
55
56
57
58
59
60
61
62
63
64
65
66
67
68
69
70
71
72
73
74
75
76
77
78
79
80
81
82
83
85
86
87
88

TABLE D4-continued

Gene modifying polypeptide candidates having a Z-score of at least 1 or greater in any one of conditions 1, 2, or 3 according to the above further analysis.
SEQ ID NOs:

89
90
91
92
94
95
96
97
98
99
100
101
102
103
104
105
106
107
108
110
112
113
114
115
116
117
118
119
120
121
122
123
124
125
126
127
128
129
130
131
132
133
134
135
136
137
138
139
140
141
142
143
144
145
146
147
148
149
150
151
153
154
155
156
157
158
159
160
161
162
163
164
165

TABLE D4-continued

Gene modifying polypeptide candidates having a Z-score of at least 1 or greater in any one of conditions 1, 2, or 3 according to the above further analysis.
SEQ ID NOs:

| |
|---|
| 166 |
| 167 |
| 168 |
| 169 |
| 170 |
| 171 |
| 172 |
| 173 |
| 174 |
| 175 |
| 176 |
| 178 |
| 179 |
| 180 |
| 181 |
| 182 |
| 183 |
| 184 |
| 185 |
| 186 |
| 187 |
| 188 |
| 190 |
| 191 |
| 192 |
| 194 |
| 195 |
| 196 |
| 197 |
| 198 |
| 199 |
| 200 |
| 201 |
| 203 |
| 204 |
| 205 |
| 206 |
| 207 |
| 208 |
| 209 |
| 210 |
| 211 |
| 212 |
| 213 |
| 214 |
| 215 |
| 216 |
| 217 |
| 218 |
| 219 |
| 220 |
| 222 |
| 223 |
| 225 |
| 226 |
| 227 |
| 228 |
| 229 |
| 230 |
| 232 |
| 234 |
| 235 |
| 236 |
| 237 |
| 238 |
| 239 |
| 240 |
| 241 |
| 242 |
| 243 |
| 244 |
| 245 |
| 248 |
| 249 |
| 251 |
| 252 |
| 253 |
| 254 |
| 255 |
| 256 |
| 257 |
| 258 |
| 259 |
| 261 |
| 262 |
| 263 |
| 264 |
| 265 |
| 268 |
| 269 |
| 270 |
| 271 |
| 272 |
| 273 |
| 274 |
| 275 |
| 276 |
| 277 |
| 278 |
| 279 |
| 280 |
| 281 |
| 283 |
| 284 |
| 285 |
| 286 |
| 287 |
| 290 |
| 293 |
| 294 |
| 295 |
| 296 |
| 297 |
| 298 |
| 300 |
| 301 |
| 302 |
| 303 |
| 304 |
| 305 |
| 306 |
| 308 |
| 309 |
| 310 |
| 312 |
| 313 |
| 315 |
| 316 |
| 317 |
| 318 |
| 319 |
| 320 |
| 321 |
| 322 |
| 323 |
| 324 |
| 325 |
| 327 |
| 328 |
| 329 |
| 330 |
| 331 |
| 332 |
| 333 |
| 334 |
| 335 |

TABLE D4-continued

Gene modifying polypeptide candidates having a Z-score of at least 1 or greater in any one of conditions 1, 2, or 3 according to the above further analysis.
SEQ ID NOs:

336
337
338
339
340
341
342
343
344
345
346
348
349
350
351
352
353
354
355
356
357
358
359
360
361
362
363
364
365
366
367
368
369
370
371
372
373
374
375
376
377
380
382
383
384
385
386
387
388
389
391
392
393
394
395
396
397
398
399
400
401
402
403
404
406
407
408
409
410
413
415
416
419
420
421
424
426
427
428
429
432
433
438
441
446
449
450
452
460
461
462
464
465
469
470
472
475
476
480
481
483
484
486
488
489
495
502
503
504
510
517
522
523
524
527
534
535
536
537
538
539
540
541
542
543
544
545
546
547
548
549
550
553
554
555
556
557
558
559
560
561
562
563
565
566
567

TABLE D4-continued

Gene modifying polypeptide candidates having a Z-score of at least 1 or greater in any one of conditions 1, 2, or 3 according to the above further analysis. SEQ ID NOs:

568
570
571
572
575
581
583
584
585
587
589
590
591
592
593
594
595
596
597
598
599
600
601
602
604
605
606
607
610
611
614
616
617
618
624
625
628
631
633
634
636
645
647
648
649
650
652
653
654
655
656
657
659
661
662
663
664
666
667
668
669
670
673
677
678
679
680
681
687
689
690
692
694

TABLE D4-continued

Gene modifying polypeptide candidates having a Z-score of at least 1 or greater in any one of conditions 1, 2, or 3 according to the above further analysis. SEQ ID NOs:

700
702
706
711
715
716
717
720
724
726
727
729
731
738
739
740
745
747
755
756
759
765
766
767
768
769
770
771
772
773
774
775
776
780
782
783
784
789
790
797
798
799
800
801
802
803
804
805
806
807
808
809
810
811
812
813
814
815
816
817
818
819
820
821
822
823
824
825
826
827
828
829
830

TABLE D4-continued

Gene modifying polypeptide candidates having a Z-score of at least 1 or greater in any one of conditions 1, 2, or 3 according to the above further analysis.
SEQ ID NOs:

| |
|---|
| 831 |
| 832 |
| 833 |
| 834 |
| 835 |
| 836 |
| 837 |
| 839 |
| 840 |
| 841 |
| 842 |
| 843 |
| 844 |
| 845 |
| 846 |
| 847 |
| 848 |
| 849 |
| 850 |
| 852 |
| 853 |
| 854 |
| 855 |
| 856 |
| 857 |
| 860 |
| 861 |
| 862 |
| 863 |
| 866 |
| 867 |
| 868 |
| 869 |
| 870 |
| 871 |
| 872 |
| 873 |
| 874 |
| 875 |
| 876 |
| 877 |
| 878 |
| 879 |
| 880 |
| 881 |
| 882 |
| 883 |
| 884 |
| 885 |
| 886 |
| 887 |
| 888 |
| 889 |
| 890 |
| 891 |
| 892 |
| 893 |
| 894 |
| 895 |
| 896 |
| 897 |
| 898 |
| 899 |
| 900 |
| 901 |
| 902 |
| 903 |
| 904 |
| 905 |
| 906 |
| 907 |
| 908 |
| 909 |
| 910 |
| 911 |
| 912 |
| 913 |
| 914 |
| 915 |
| 916 |
| 917 |
| 918 |
| 919 |
| 920 |
| 921 |
| 922 |
| 923 |
| 924 |
| 925 |
| 926 |
| 927 |
| 928 |
| 929 |
| 930 |
| 931 |
| 932 |
| 933 |
| 934 |
| 936 |
| 937 |
| 938 |
| 939 |
| 940 |
| 942 |
| 943 |
| 944 |
| 945 |
| 946 |
| 948 |
| 950 |
| 951 |
| 952 |
| 957 |
| 958 |
| 959 |
| 960 |
| 961 |
| 962 |
| 963 |
| 964 |
| 965 |
| 966 |
| 967 |
| 968 |
| 969 |
| 970 |
| 971 |
| 972 |
| 973 |
| 974 |
| 975 |
| 976 |
| 977 |
| 978 |
| 979 |
| 980 |
| 981 |
| 982 |
| 983 |
| 984 |
| 985 |
| 986 |
| 987 |
| 988 |
| 989 |
| 990 |

TABLE D4-continued

Gene modifying polypeptide candidates having a Z-score of at least 1 or greater in any one of conditions 1, 2, or 3 according to the above further analysis.
SEQ ID NOs:

991
992
993
994
996
997
999
1000
1001
1003
1004
1006
1007
1008
1009
1010
1011
1012
1013
1014
1015
1016
1017
1018
1019
1020
1021
1022
1023
1024
1025
1026
1027
1028
1029
1030
1031
1032
1033
1034
1035
1036
1037
1038
1039
1040
1041
1042
1043
1044
1045
1046
1047
1048
1049
1050
1051
1052
1053
1054
1055
1056
1057
1058
1059
1060
1061
1062
1063
1064
1065
1066
1067
1068
1069
1070
1071
1072
1073
1074
1075
1076
1077
1078
1079
1080
1081
1082
1083
1084
1085
1086
1087
1088
1089
1090
1091
1092
1093
1094
1095
1097
1103
1110
1115
1116
1117
1118
1119
1120
1121
1122
1124
1126
1131
1134
1136
1137
1138
1139
1140
1141
1142
1143
1144
1145
1146
1147
1148
1149
1150
1151
1152
1153
1154
1155
1156
1157
1158
1159
1160
1161
1162
1163
1164
1165

TABLE D4-continued

Gene modifying polypeptide candidates having a Z-score of at least 1 or greater in any one of conditions 1, 2, or 3 according to the above further analysis.
SEQ ID NOs:

1166
1167
1168
1169
1170
1171
1172
1173
1174
1176
1177
1178
1181
1182
1184
1185
1186
1187
1188
1190
1193
1197
1198
1199
1200
1201
1202
1203
1204
1205
1206
1207
1208
1209
1210
1211
1212
1213
1214
1215
1216
1217
1218
1219
1220
1221
1222
1223
1224
1225
1226
1227
1228
1229
1230
1231
1232
1233
1234
1235
1236
1237
1238
1239
1240
1241
1242
1243
1244
1245
1246
1247
1248

TABLE D4-continued

Gene modifying polypeptide candidates having a Z-score of at least 1 or greater in any one of conditions 1, 2, or 3 according to the above further analysis.
SEQ ID NOs:

1249
1250
1251
1252
1253
1254
1255
1256
1257
1258
1259
1261
1262
1263
1264
1265
1266
1267
1269
1270
1271
1272
1273
1274
1275
1277
1278
1279
1280
1282
1288
1290
1295
1296
1298
1299
1301
1302
1304
1305
1308
1311
1312
1314
1315
1320
1322
1324
1326
1327
1328
1329
1338
1340
1342
1346
1347
1348
1349
1350
1351
1354
1359
1362
1365
1366
1369
1370
1371
1372
1373
1374
1375

TABLE D4-continued

Gene modifying polypeptide candidates having a Z-score of at least 1 or greater in any one of conditions 1, 2, or 3 according to the above further analysis.
SEQ ID NOs:

| |
|---|
| 1376 |
| 1377 |
| 1378 |
| 1379 |
| 1380 |
| 1381 |
| 1382 |
| 1383 |
| 1384 |
| 1385 |
| 1386 |
| 1387 |
| 1388 |
| 1389 |
| 1390 |
| 1391 |
| 1392 |
| 1393 |
| 1394 |
| 1395 |
| 1396 |
| 1397 |
| 1398 |
| 1399 |
| 1400 |
| 1401 |
| 1402 |
| 1403 |
| 1404 |
| 1405 |
| 1406 |
| 1407 |
| 1408 |
| 1409 |
| 1410 |
| 1411 |
| 1412 |
| 1413 |
| 1414 |
| 1415 |
| 1416 |
| 1417 |
| 1418 |
| 1419 |
| 1420 |
| 1421 |
| 1422 |
| 1423 |
| 1424 |
| 1425 |
| 1426 |
| 1427 |
| 1428 |
| 1429 |
| 1430 |
| 1431 |
| 1432 |
| 1433 |
| 1434 |
| 1435 |
| 1436 |
| 1437 |
| 1439 |
| 1440 |
| 1441 |
| 1442 |
| 1443 |
| 1444 |
| 1445 |
| 1446 |
| 1447 |
| 1449 |
| 1450 |

TABLE D4-continued

Gene modifying polypeptide candidates having a Z-score of at least 1 or greater in any one of conditions 1, 2, or 3 according to the above further analysis.
SEQ ID NOs:

| |
|---|
| 1451 |
| 1452 |
| 1455 |
| 1456 |
| 1460 |
| 1462 |
| 1471 |
| 1473 |
| 1475 |
| 1488 |
| 1489 |
| 1491 |
| 1492 |
| 1493 |
| 1497 |
| 1499 |
| 1504 |
| 1505 |
| 1506 |
| 1507 |
| 1508 |
| 1510 |
| 1513 |
| 1515 |
| 1519 |
| 1521 |
| 1523 |
| 1524 |
| 1527 |
| 1529 |
| 1531 |
| 1539 |
| 1540 |
| 1541 |
| 1542 |
| 1543 |
| 1544 |
| 1545 |
| 1546 |
| 1547 |
| 1548 |
| 1549 |
| 1550 |
| 1551 |
| 1552 |
| 1553 |
| 1554 |
| 1555 |
| 1556 |
| 1557 |
| 1558 |
| 1559 |
| 1560 |
| 1561 |
| 1563 |
| 1564 |
| 1565 |
| 1566 |
| 1567 |
| 1568 |
| 1570 |
| 1571 |
| 1572 |
| 1573 |
| 1574 |
| 1575 |
| 1576 |
| 1577 |
| 1578 |
| 1579 |
| 1580 |
| 1581 |
| 1582 |

TABLE D4-continued

Gene modifying polypeptide candidates having a Z-score of at least 1 or greater in any one of conditions 1, 2, or 3 according to the above further analysis.
SEQ ID NOs:

| SEQ ID NOs |
|---|
| 1583 |
| 1584 |
| 1585 |
| 1588 |
| 1590 |
| 1592 |
| 1593 |
| 1594 |
| 1597 |
| 1598 |
| 1599 |
| 1600 |
| 1604 |
| 1605 |
| 1606 |
| 1607 |
| 1608 |
| 1610 |
| 1611 |
| 1612 |
| 1616 |
| 1617 |
| 1618 |
| 1619 |
| 1620 |
| 1621 |
| 1622 |
| 1623 |
| 1624 |
| 1625 |
| 1626 |
| 1627 |
| 1628 |
| 1629 |
| 1630 |
| 1631 |
| 1632 |
| 1633 |
| 1634 |
| 1635 |
| 1636 |
| 1637 |
| 1638 |
| 1639 |
| 1640 |
| 1641 |
| 1642 |
| 1644 |
| 1645 |
| 1646 |
| 1648 |
| 1649 |
| 1651 |
| 1652 |
| 1653 |
| 1654 |
| 1655 |
| 1656 |
| 1657 |
| 1658 |
| 1659 |
| 1660 |
| 1661 |
| 1662 |
| 1663 |
| 1664 |
| 1665 |
| 1666 |
| 1667 |
| 1668 |
| 1669 |
| 1670 |
| 1671 |
| 1672 |
| 1673 |
| 1674 |
| 1675 |
| 1676 |
| 1677 |
| 1678 |
| 1679 |
| 1680 |
| 1681 |
| 1682 |
| 1683 |
| 1684 |
| 1685 |
| 1686 |
| 1687 |
| 1688 |
| 1689 |
| 1690 |
| 1691 |
| 1692 |
| 1693 |
| 1694 |
| 1695 |
| 1696 |
| 1697 |
| 1698 |
| 1699 |
| 1700 |
| 1701 |
| 1702 |
| 1703 |
| 1704 |
| 1705 |
| 1706 |
| 1707 |
| 1708 |
| 1709 |
| 1710 |
| 1711 |
| 1712 |
| 1713 |
| 1714 |
| 1715 |
| 1716 |
| 1717 |
| 1718 |
| 1719 |
| 1720 |
| 1721 |
| 1722 |
| 1723 |
| 1725 |
| 1726 |
| 1728 |
| 1729 |
| 1730 |
| 1731 |
| 1733 |
| 1734 |
| 1735 |
| 1736 |
| 1737 |
| 1738 |
| 1739 |
| 1741 |
| 1742 |
| 1743 |
| 1744 |
| 1745 |
| 1747 |
| 1748 |
| 1750 |

TABLE D4-continued

Gene modifying polypeptide candidates having a Z-score of at least 1 or greater in any one of conditions 1, 2, or 3 according to the above further analysis. SEQ ID NOs:

| SEQ ID NOs: |
|---|
| 1751 |
| 1752 |
| 1753 |
| 1754 |
| 1755 |
| 1756 |
| 1757 |
| 1758 |
| 1759 |
| 1760 |
| 1761 |
| 1762 |
| 1764 |
| 1765 |
| 1766 |
| 1767 |
| 1769 |
| 1770 |
| 1771 |
| 1772 |
| 1773 |
| 1774 |
| 1775 |
| 1776 |
| 1777 |
| 1778 |
| 1779 |
| 1780 |
| 1781 |
| 1782 |
| 1783 |
| 1784 |
| 1785 |
| 1786 |
| 1787 |
| 1788 |
| 1789 |
| 1790 |
| 1792 |
| 1793 |
| 1794 |
| 1795 |
| 1796 |
| 1797 |
| 1799 |
| 1800 |
| 1801 |
| 1802 |
| 1803 |
| 1804 |
| 1805 |
| 1806 |
| 1808 |
| 1809 |
| 1810 |
| 1811 |
| 1812 |
| 1813 |
| 1815 |
| 1816 |
| 1818 |
| 1819 |
| 1824 |
| 1825 |
| 1827 |
| 1828 |
| 1829 |
| 1831 |
| 1834 |
| 1835 |
| 1838 |
| 1840 |
| 1842 |
| 1843 |
| 1844 |
| 1845 |
| 1846 |
| 1847 |
| 1848 |
| 1849 |
| 1850 |
| 1851 |
| 1852 |
| 1853 |
| 1855 |
| 1856 |
| 1857 |
| 1858 |
| 1859 |
| 1860 |
| 1861 |
| 1862 |
| 1863 |
| 1864 |
| 1865 |
| 1866 |
| 1867 |
| 1868 |
| 1869 |
| 1870 |
| 1871 |
| 1872 |
| 1873 |
| 1874 |
| 1875 |
| 1876 |
| 1877 |
| 1878 |
| 1879 |
| 1880 |
| 1881 |
| 1882 |
| 1883 |
| 1884 |
| 1885 |
| 1886 |
| 1887 |
| 1888 |
| 1889 |
| 1890 |
| 1891 |
| 1892 |
| 1893 |
| 1894 |
| 1895 |
| 1896 |
| 1897 |
| 1898 |
| 1899 |
| 1900 |
| 1901 |
| 1902 |
| 1903 |
| 1904 |
| 1905 |
| 1906 |
| 1907 |
| 1908 |
| 1909 |
| 1910 |
| 1911 |
| 1912 |
| 1913 |
| 1914 |
| 1915 |
| 1916 |

TABLE D4-continued

Gene modifying polypeptide candidates having a Z-score of at least 1 or greater in any one of conditions 1, 2, or 3 according to the above further analysis. SEQ ID NOs:

| |
|---|
| 1917 |
| 1918 |
| 1920 |
| 1921 |
| 1922 |
| 1923 |
| 1924 |
| 1925 |
| 1926 |
| 1927 |
| 1928 |
| 1929 |
| 1931 |
| 1932 |
| 1934 |
| 1935 |
| 1936 |
| 1937 |
| 1938 |
| 1939 |
| 1940 |
| 1941 |
| 1942 |
| 1943 |
| 1944 |
| 1945 |
| 1946 |
| 1947 |
| 1948 |
| 1949 |
| 1950 |
| 1951 |
| 1952 |
| 1953 |
| 1954 |
| 1955 |
| 1956 |
| 1957 |
| 1958 |
| 1959 |
| 1960 |
| 1961 |
| 1962 |
| 1963 |
| 1964 |
| 1965 |
| 1966 |
| 1967 |
| 1968 |
| 1969 |
| 1970 |
| 1971 |
| 1972 |
| 1973 |
| 1974 |
| 1975 |
| 1976 |
| 1977 |
| 1978 |
| 1979 |
| 1980 |
| 1981 |
| 1982 |
| 1983 |
| 1984 |
| 1985 |
| 1986 |
| 1987 |
| 1988 |
| 1989 |
| 1990 |
| 1991 |
| 1992 |

TABLE D4-continued

Gene modifying polypeptide candidates having a Z-score of at least 1 or greater in any one of conditions 1, 2, or 3 according to the above further analysis. SEQ ID NOs:

| |
|---|
| 1993 |
| 1994 |
| 1995 |
| 1996 |
| 1997 |
| 1998 |
| 1999 |
| 2000 |
| 2001 |
| 2002 |
| 2003 |
| 2004 |
| 2005 |
| 2006 |
| 2007 |
| 2008 |
| 2009 |
| 2010 |
| 2011 |
| 2012 |
| 2013 |
| 2014 |
| 2015 |
| 2017 |
| 2018 |
| 2019 |
| 2020 |
| 2021 |
| 2022 |
| 2023 |
| 2024 |
| 2025 |
| 2026 |
| 2027 |
| 2028 |
| 2029 |
| 2030 |
| 2031 |
| 2033 |
| 2034 |
| 2035 |
| 2036 |
| 2037 |
| 2038 |
| 2039 |
| 2040 |
| 2041 |
| 2042 |
| 2043 |
| 2044 |
| 2045 |
| 2046 |
| 2047 |
| 2048 |
| 2049 |
| 2050 |
| 2051 |
| 2052 |
| 2053 |
| 2054 |
| 2055 |
| 2056 |
| 2057 |
| 2058 |
| 2059 |
| 2060 |
| 2061 |
| 2062 |
| 2063 |
| 2064 |
| 2066 |
| 2069 |
| 2070 |

TABLE D4-continued

Gene modifying polypeptide candidates having a Z-score of at least 1 or greater in any one of conditions 1, 2, or 3 according to the above further analysis.
SEQ ID NOs:

2071
2072
2074
2075
2076
2079
2080
2081
2082
2084
2086
2089
2090
2091
2092
2093
2094
2095
2096
2097
2098
2099
2100
2101
2102
2103
2104
2105
2106
2107
2108
2109
2111
2112
2113
2114
2115
2116
2117
2118
2119
2120
2121
2122
2123
2125
2126
2128
2129
2130
2132
2133
2135
2136
2137
2138
2140
2141
2142
2143
2144
2145
2146
2147
2148
2149
2150
2151
2152
2153
2154
2155
2156

TABLE D4-continued

Gene modifying polypeptide candidates having a Z-score of at least 1 or greater in any one of conditions 1, 2, or 3 according to the above further analysis.
SEQ ID NOs:

2158
2159
2161
2162
2163
2164
2165
2166
2167
2168
2170
2171
2172
2173
2174
2175
2176
2177
2178
2179
2180
2182
2183
2184
2185
2186
2188
2189
2190
2191
2192
2193
2194
2195
2196
2197
2198
2199
2200
2201
2202
2204
2205
2206
2207
2210
2211
2212
2213
2214
2218
2219
2222
2223
2224
2225
2226
2227
2228
2229
2230
2231
2232
2233
2234
2235
2236
2237
2238
2239
2240
2241
2242

TABLE D4-continued

Gene modifying polypeptide candidates having a Z-score of at least 1 or greater in any one of conditions 1, 2, or 3 according to the above further analysis.
SEQ ID NOs:

| |
|---|
| 2244 |
| 2245 |
| 2246 |
| 2247 |
| 2248 |
| 2249 |
| 2250 |
| 2251 |
| 2252 |
| 2253 |
| 2254 |
| 2255 |
| 2256 |
| 2257 |
| 2259 |
| 2260 |
| 2261 |
| 2262 |
| 2263 |
| 2264 |
| 2265 |
| 2266 |
| 2268 |
| 2270 |
| 2271 |
| 2272 |
| 2273 |
| 2274 |
| 2275 |
| 2276 |
| 2277 |
| 2278 |
| 2279 |
| 2280 |
| 2281 |
| 2282 |
| 2286 |
| 2287 |
| 2288 |
| 2289 |
| 2291 |
| 2293 |
| 2294 |
| 2295 |
| 2299 |
| 2300 |
| 2301 |
| 2302 |
| 2303 |
| 2304 |
| 2305 |
| 2306 |
| 2307 |
| 2308 |
| 2309 |
| 2310 |
| 2311 |
| 2312 |
| 2313 |
| 2314 |
| 2315 |
| 2316 |
| 2317 |
| 2318 |
| 2319 |
| 2320 |
| 2321 |
| 2322 |
| 2323 |
| 2324 |
| 2325 |
| 2326 |
| 2327 |

TABLE D4-continued

Gene modifying polypeptide candidates having a Z-score of at least 1 or greater in any one of conditions 1, 2, or 3 according to the above further analysis.
SEQ ID NOs:

| |
|---|
| 2328 |
| 2329 |
| 2330 |
| 2331 |
| 2332 |
| 2333 |
| 2334 |
| 2335 |
| 2336 |
| 2337 |
| 2338 |
| 2339 |
| 2340 |
| 2341 |
| 2342 |
| 2343 |
| 2344 |
| 2345 |
| 2346 |
| 2347 |
| 2348 |
| 2349 |
| 2350 |
| 2351 |
| 2352 |
| 2353 |
| 2354 |
| 2355 |
| 2356 |
| 2357 |
| 2358 |
| 2359 |
| 2360 |
| 2361 |
| 2362 |
| 2363 |
| 2364 |
| 2365 |
| 2366 |
| 2367 |
| 2368 |
| 2369 |
| 2370 |
| 2371 |
| 2372 |
| 2373 |
| 2374 |
| 2375 |
| 2376 |
| 2377 |
| 2378 |
| 2379 |
| 2380 |
| 2381 |
| 2382 |
| 2383 |
| 2384 |
| 2385 |
| 2386 |
| 2387 |
| 2388 |
| 2389 |
| 2390 |
| 2391 |
| 2392 |
| 2393 |
| 2394 |
| 2395 |
| 2396 |
| 2397 |
| 2398 |
| 2399 |
| 2400 |

TABLE D4-continued

Gene modifying polypeptide candidates having a Z-score of at least 1 or greater in any one of conditions 1, 2, or 3 according to the above further analysis. SEQ ID NOs:

2401
2402
2403
2404
2405
2406
2407
2408
2409
2410
2411
2412
2413
2414
2415
2416
2417
2418
2419
2420
2422
2423
2424
2425
2426
2427
2431
2436
2438
2440
2441
2442
2443
2444
2445
2446
2447
2448
2449
2450
2451
2452
2453
2454
2455
2456
2457
2458
2459
2460
2461
2462
2463
2464
2465
2466
2467
2468
2469
2470
2471
2472
2473
2474
2476
2477
2478
2479
2480
2481
2482
2483
2484

TABLE D4-continued

Gene modifying polypeptide candidates having a Z-score of at least 1 or greater in any one of conditions 1, 2, or 3 according to the above further analysis. SEQ ID NOs:

2485
2488
2489
2490
2491
2492
2497
2498
2501
2502
2503
2504
2505
2506
2507
2508
2509
2510
2511
2512
2513
2514
2515
2516
2517
2518
2519
2520
2521
2522
2523
2524
2525
2526
2527
2528
2529
2530
2531
2532
2533
2534
2535
2536
2537
2538
2539
2540
2541
2542
2543
2544
2545
2546
2547
2548
2549
2550
2551
2552
2553
2554
2555
2556
2557
2558
2559
2560
2561
2562
2563
2564
2565

TABLE D4-continued

Gene modifying polypeptide candidates having a Z-score of at least 1 or greater in any one of conditions 1, 2, or 3 according to the above further analysis.
SEQ ID NOs:

2566
2567
2568
2569
2570
2571
2572
2573
2574
2575
2576
2577
2578
2579
2580
2581
2582
2583
2584
2585
2586
2587
2588
2589
2590
2591
2592
2593
2594
2595
2596
2597
2598
2599
2600
2601
2602
2603
2604
2605
2606
2607
2608
2610
2611
2612
2613
2614
2615
2616
2617
2618
2619
2620
2621
2622
2623
2624
2625
2626
2627
2628
2629
2630
2631
2632
2633
2634
2635
2636
2637
2638
2639

TABLE D4-continued

Gene modifying polypeptide candidates having a Z-score of at least 1 or greater in any one of conditions 1, 2, or 3 according to the above further analysis.
SEQ ID NOs:

2640
2641
2642
2643
2644
2645
2646
2647
2648
2649
2650
2651
2652
2653
2654
2655
2656
2657
2658
2659
2660
2661
2662
2663
2664
2665
2666
2667
2668
2669
2670
2671
2672
2673
2674
2675
2676
2677
2678
2679
2680
2681
2682
2683
2684
2685
2687
2688
2689
2690
2691
2692
2693
2694
2695
2697
2698
2699
2700
2701
2702
2703
2704
2708
2709
2710
2711
2712
2713
2714
2715
2716
2717

TABLE D4-continued

Gene modifying polypeptide candidates having a Z-score of at least 1 or greater in any one of conditions 1, 2, or 3 according to the above further analysis. SEQ ID NOs:

2718
2719
2720
2721
2722
2723
2724
2725
2726
2727
2728
2729
2730
2731
2732
2733
2734
2735
2736
2737
2738
2739
2740
2741
2742
2743
2744
2745
2746
2747
2748
2750
2751
2752
2753
2754
2755
2756
2757
2758
2759
2760
2761
2762
2763
2764
2765
2766
2767
2768
2769
2771
2772
2773
2774
2775
2776
2778
2779
2780
2781
2782
2783
2784
2785
2786
2787
2788
2789
2790
2791
2792
2793
2794
2795
2796
2797
2798
2799
2800
2801
2802
2803
2804
2805
2806
2807
2808
2809
2810
2811
2812
2813
2814
2815
2816
2817
2818
2819
2820
2821
2822
2823
2824
2825
2826
2827
2828
2829
2830
2831
2832
2833
2834
2835
2836
2837
2838
2839
2840
2841
2842
2843
2844
2845
2846
2847
2848
2849
2850
2851
2852
2853
2854
2855
2856
2857
2858
2859
2860
2861
2862
2864
2865
2866
2867

TABLE D4-continued

Gene modifying polypeptide candidates having a Z-score of at least 1 or greater in any one of conditions 1, 2, or 3 according to the above further analysis.
SEQ ID NOs:

2868
2869
2870
2871
2872
2873
2874
2875
2876
2877
2878
2880
2881
2882
2884
2885
2886
2887
2888
2889
2890
2891
2892
2893
2894
2895
2896
2897
2898
2900
2901
2903
2904
2905
2906
2907
2908
2909
2910
2911
2912
2913
2914
2915
2916
2917
2918
2919
2920
2921
2922
2923
2925
2926
2927
2928
2929
2930
2931
2932
2933
2934
2935
2936
2937
2938
2939
2940
2941
2942
2943
2944
2945

TABLE D4-continued

Gene modifying polypeptide candidates having a Z-score of at least 1 or greater in any one of conditions 1, 2, or 3 according to the above further analysis.
SEQ ID NOs:

2946
2947
2948
2950
2951
2952
2953
2954
2955
2957
2958
2959
2960
2962
2965
2966
2967
2968
2969
2971
2972
2973
2974
2975
2976
2979
2981
2982
2983
2984
2985
2986
2987
2988
2989
2990
2991
2992
2993
2994
2995
2997
2998
2999
3001
3002
3003
3004
3005
3006
3007
3008
3009
3010
3011
3012
3014
3015
3016
3018
3019
3020
3021
3022
3023
3025
3026
3027
3028
3029
3030
3031
3033

TABLE D4-continued

Gene modifying polypeptide candidates having a Z-score of at least 1 or greater in any one of conditions 1, 2, or 3 according to the above further analysis.
SEQ ID NOs:

3034
3035
3036
3037
3038
3039
3040
3041
3042
3043
3044
3045
3046
3047
3048
3049
3050
3051
3052
3053
3054
3055
3056
3057
3058
3059
3060
3061
3062
3063
3064
3065
3066
3067
3070
3071
3072
3073
3074
3075
3076
3077
3078
3079
3080
3081
3082
3083
3084
3085
3086
3087
3088
3089
3090
3091
3092
3093
3094
3096
3097
3098
3099
3100
3101
3102
3103
3104
3107
3108
3109
3110
3111

TABLE D4-continued

Gene modifying polypeptide candidates having a Z-score of at least 1 or greater in any one of conditions 1, 2, or 3 according to the above further analysis.
SEQ ID NOs:

3112
3113
3114
3115
3116
3117
3118
3119
3120
3121
3122
3123
3124
3125
3126
3127
3128
3129
3130
3131
3133
3134
3135
3136
3138
3139
3141
3142
3144
3146
3152
3153
3154
3155
3157
3162
3166
3167
3169
3171
3172
3173
3175
3176
3177
3180
3181
3183
3184
3188
3190
3196
3198
3199
3201
3202
3203
3204
3205
3206
3207
3208
3209
3211
3213
3214
3219
3220
3223
3225
3228
3233
3235

TABLE D4-continued

Gene modifying polypeptide candidates having a Z-score of at least 1 or greater in any one of conditions 1, 2, or 3 according to the above further analysis.
SEQ ID NOs:

3240
3247
3248
3251
3252
3253
3254
3256
3259
3260
3261
3262
3263
3264
3266
3268
3269
3270
3272
3276
3277
3279
3282
3283
3286
3294
3296
3298
3300
3302
3303
3305
3306
3310
3313
3315
3316
3318
3323
3326
3329
4501
4502
4503
4504
4505
4506
4507
4508
4509
4510
4511
4512
4513
4514
4515
4516
4517
4518
4519
4520
4521
4522
4523
4524
4525
4526
4527
4528
4529
4530
4531
4532
4533
4534
4535
4536
4537
4538
4539
4540
4541
6001
6004
6007
6008
6010
6012
6013
6014
6015
6021
6022
6023
6025
6026
6028
6029
6030
6031
6036
6038
6040
6041
6043
6045
6048
6049
6051
6054
6055
6056
6057
6058
6059
6060
6061
6063
6064
6067
6068
6069
6071
6072
6073
6074
6076
6079
6080
6081
6083
6084
6089
6090
6091
6092
6093
6094
6096
6097
6099
6103
6105
6106
6107
6108

TABLE D4-continued

Gene modifying polypeptide candidates having a Z-score of at least 1 or greater in any one of conditions 1, 2, or 3 according to the above further analysis.
SEQ ID NOs:

6112
6115
6117
6121
6122
6123
6129
6130
6133
6136
6138
6139
6142
6143
6144
6147
6148
6150
6151
6152
6153
6155
6158
6160
6164
6165
6168
6169
6171
6172
6173
6174
6175
6176
6177
6178
6179
6180
6181
6182
6184
6185
6188
6189
6190
6191
6193
6196
6197
6200
6201
6203
6204
6205
6207
6208
6215
6216
6218
6219
6223
6227
6234
6235
6236
6237
6240
6244
6247
6248
6250
6253
6254

TABLE D4-continued

Gene modifying polypeptide candidates having a Z-score of at least 1 or greater in any one of conditions 1, 2, or 3 according to the above further analysis.
SEQ ID NOs:

6255
6257
6258
6263
6264
6265
6266
6267
6268
6269
6271
6272
6273
6275
6277
6278
6279
6280
6281
6282
6284
6285
6286
6287
6288
6290
6292
6293
6294
6298
6299
6304
6305
6307
6308
6309
6310
6311
6312
6313
6314
6315
6317
6319
6320
6322
6324
6325
6327
6328
6329
6334
6335
6339
6340
6343
6344
6345
6347
6349
6350
6351
6352
6353
6355
6356
6358
6359
6360
6363
6364
6366
6367

TABLE D4-continued

Gene modifying polypeptide candidates having a Z-score of at least 1 or greater in any one of conditions 1, 2, or 3 according to the above further analysis. SEQ ID NOs:

6370
6374
6377
6378
6380
6381
6384
6389
6390
6393
6394
6395
6396
6397
6402
6403
6407
6409
6410
6411
6412
6415
6417
6418
6419
6420
6421
6423
6424
6425
6426
6427
6431
6432
6433
6434
6435
6439
6440
6441
6442
6443
6444
6445
6449
6451
6453
6454
6455
6456
6457
6458
6459
6460
6461
6462
6465
6467
6469
6474
6476
6477
6478
6479
6480
6486
6488
6491
6492
6493
6495
6497
6499
6501
6502
6503
6505
6506
6511
6512
6515
6524
6525
6526
6527
6529
6530
6531
6532
6533
6535
6538
6540
6542
6543
6544
6545
6549
6551
6552
6555
6557
6559
6561
6563
6564
6565
6566
6567
6568
6572
6575
6577
6579
6580
6581
6582
6583
6584
6585
6587
6589
6590
6591
6594
6595
6596
6598
6600
6601
6602
6603
6606
6607
6608
6609
6610
6611
6612
6613
6614
6615
6617
6618
6619
6621

TABLE D4-continued

Gene modifying polypeptide candidates having a Z-score of at least 1 or greater in any one of conditions 1, 2, or 3 according to the above further analysis.
SEQ ID NOs:

6622
6623
6624
6625
6627
6629
6630
6632
6635
6639
6642
6644
6645
6646
6648
6650
6651
6652
6654
6655
6656
6659
6664
6665
6666
6671
6674
6675
6676
6679
6680
6681
6683
6684
6685
6686
6687
6688
6690
6691
6692
6693
6695
6698
6705
6706
6708
6709
6713
6715
6716
6717
6718
6719
6720
6722
6724
6726
6728
6730
6731
6732
6733
6736
6738
6744
6746
6750
6751
6754
6756
6757
6758
6760
6761
6762
6765
6772
6773
6774
6776
6777
6778
6782
6783
6784
6785
6786
6788
6792
6793
6794
6795
6796
6797
6798
6800
6801
6802
6803
6808
6809
6811
6815
6822
6824
6826
6827
6829
6832
6833
6834
6835
6837
6841
6842
6845
6850
6852
6855
6857
6858
6859
6861
6863
6864
6865
6866
6867
6868
6869
6870
6872
6873
6874
6876
6877
6878
6879
6881
6882
6883
6885
6886
6890
6891

TABLE D4-continued

Gene modifying polypeptide candidates having a Z-score of at least 1 or greater in any one of conditions 1, 2, or 3 according to the above further analysis.
SEQ ID NOs:

6892
6894
6896
6897
6898
6902
6906
6907
6908
6910
6911
6915
6917
6919
6920
6923
6925
6928
6930
6931
6932
6933
6934
6939
6942
6943
6944
6948
6950
6951
6952
6954
6961
6965
6966
6968
6969
6972
6974
6978
6979
6980
6982
6984
6985
6990
6993
6998
6999
7001
7003
7005
7006
7008
7009
7012
7013
7014
7015
7017
7021
7023
7024
7025
7026
7027
7030
7031
7033
7034
7035
7036
7037

TABLE D4-continued

Gene modifying polypeptide candidates having a Z-score of at least 1 or greater in any one of conditions 1, 2, or 3 according to the above further analysis.
SEQ ID NOs:

7038
7040
7043
7045
7046
7047
7049
7050
7051
7052
7053
7055
7056
7058
7059
7060
7062
7063
7064
7065
7067
7068
7070
7072
7073
7074
7075
7078
7079
7080
7081
7082
7084
7085
7087
7088
7089
7091
7092
7095
7096
7098
7100
7103
7104
7105
7109
7110
7111
7114
7115
7116
7120
7121
7123
7125
7127
7128
7129
7131
7133
7134
7135
7136
7140
7141
7142
7143
7144
7147
7148
7149
7150

TABLE D4-continued

Gene modifying polypeptide candidates having a Z-score of at least 1 or greater in any one of conditions 1, 2, or 3 according to the above further analysis. SEQ ID NOs:

7151
7153
7154
7155
7156
7158
7159
7160
7163
7164
7167
7169
7170
7171
7172
7174
7175
7176
7180
7181
7184
7186
7187
7188
7191
7192
7194
7196
7197
7198
7201
7203
7204
7206
7209
7212
7214
7215
7216
7217
7218
7220
7221
7222
7226
7227
7228
7230
7232
7236
7240
7242
7243
7244
7246
7247
7250
7251
7252
7253
7255
7258
7260
7261
7262
7263
7264
7266
7267
7273
7274
7275
7276
7281
7282
7284
7286
7288
7291
7292
7293
7294
7297
7298
7299
7301
7302
7303
7305
7306
7307
7311
7312
7313
7317
7320
7322
7323
7326
7327
7328
7329
7331
7335
7336
7339
7342
7343
7345
7346
7347
7348
7349
7350
7352
7357
7358
7360
7361
7362
7364
7368
7369
7370
7371
7372
7374
7375
7377
7378
7379
7380
7381
7384
7387
7388
7389
7390
7392
7393
7394
7396
7397
7400
7402
7403

TABLE D4-continued

Gene modifying polypeptide candidates having a Z-score of at least 1 or greater in any one of conditions 1, 2, or 3 according to the above further analysis.
SEQ ID NOs:

7404
7412
7413
7415
7416
7417
7418
7419
7424
7430
7431
7433
7434
7435
7436
7441
7442
7443
7444
7445
7448
7449
7450
7452
7453
7455
7458
7461
7466
7469
7471
7472
7473
7474
7476
7477
7479
7483
7485
7488
7489
7493
7496
7497
7499
7500
7501
7502
7507
7508
7509
7510
7511
7513
7515
7516
7518
7519
7520
7523
7525
7526
7529
7530
7532
7536
7537
7538
7540
7541
7545
7547
7548
7549
7550
7555
7556
7558
7560
7562
7565
7566
7567
7569
7570
7574
7575
7576
7580
7582
7585
7587
7588
7590
7591
7592
7595
7596
7597
7599
7600
7603
7606
7607
7610
7612
7613
7615
7620
7621
7624
7625
7626
7629
7631
7632
7633
7634
7635
7636
7638
7643
7644
7646
7649
7650
7651
7652
7653
7654
7656
7657
7658
7659
7660
7662
7663
7665
7667
7668
7669
7670
7674
7675
7676
7677

TABLE D4-continued

Gene modifying polypeptide candidates having a Z-score of at least 1 or greater in any one of conditions 1, 2, or 3 according to the above further analysis.
SEQ ID NOs:

7679
7681
7682
7685
7686
7689
7693
7694
7695
7698
7700
7701
7702
7706
7707
7708
7713
7715
7717
7719
7721
7722
7723
7724
7726
7727
7729
7730
7731
7732
7737
7740
7741

Sequencing libraries were re-generated for the original DNA extracted from the test template g10 in U2OS cells (condition 4) and yielded a new dataset amenable to integration into the analyses of genome editing activity. The expanded analysis identified a subset of approximately 200 gene modifying polypeptide candidates having a Z-score of at least 1 or greater across all of conditions 1, 2, 3, and 4. These results show that this subset of gene modifying polypeptides had editing activity in all conditions of the screening assay under this revised analysis. These include gene modifying polypeptides having amino acid sequences according to any one of the SEQ ID NOs listed in Table D5 below.

TABLE D5

Gene modifying polypeptide candidates having a Z-score of at least 1 or greater in all of conditions 1, 2, 3, and 4.
SEQ ID NOs 34
36
37
39
123
140
142
190
192
232
252
303

TABLE D5-continued

Gene modifying polypeptide candidates having a Z-score of at least 1 or greater in all of conditions 1, 2, 3, and 4.
SEQ ID NOs 316
332
386
647
800
804
876
878
880
884
901
915
929
961
964
967
1006
1012
1016
1017
1018
1019
1022
1023
1029
1038
1052
1059
1061
1137
1198
1210
1225
1242
1371
1374
1375
1376
1382
1383
1384
1385
1390
1394
1397
1400
1415
1419
1422
1666
1686
1690
1691
1863
1870
1937
1939
1940
1942
1953
1961
1968
1970
1976
1978
2048
2086
2093
2137
2172
2174
2300
2301
2302

TABLE D5-continued

Gene modifying polypeptide candidates having a Z-score of at least 1 or greater in all of conditions 1, 2, 3, and 4.
SEQ ID NOs

| |
|---|
| 2303 |
| 2309 |
| 2314 |
| 2316 |
| 2319 |
| 2322 |
| 2325 |
| 2326 |
| 2327 |
| 2328 |
| 2329 |
| 2331 |
| 2338 |
| 2342 |
| 2347 |
| 2353 |
| 2363 |
| 2364 |
| 2365 |
| 2371 |
| 2382 |
| 2395 |
| 2403 |
| 2449 |
| 2504 |
| 2505 |
| 2508 |
| 2510 |
| 2511 |
| 2512 |
| 2515 |
| 2519 |
| 2526 |
| 2536 |
| 2542 |
| 2544 |
| 2551 |
| 2556 |
| 2566 |
| 2578 |
| 2585 |
| 2592 |
| 2610 |
| 2611 |
| 2612 |
| 2615 |
| 2618 |
| 2623 |
| 2624 |
| 2627 |
| 2629 |
| 2632 |
| 2633 |
| 2636 |
| 2638 |
| 2639 |
| 2644 |
| 2647 |
| 2666 |
| 2675 |
| 2681 |
| 2731 |
| 2780 |
| 2782 |
| 2784 |
| 2787 |
| 2789 |
| 2791 |
| 2800 |
| 2801 |
| 2802 |
| 2804 |
| 2813 |
| 2817 |
| 2826 |
| 2833 |
| 2835 |
| 2838 |
| 2865 |
| 2874 |
| 2877 |
| 2887 |
| 2888 |
| 2890 |
| 2901 |
| 2904 |
| 2909 |
| 2922 |
| 2928 |
| 2932 |
| 2937 |
| 2943 |
| 2948 |
| 2950 |
| 3053 |
| 3059 |
| 3067 |
| 3076 |
| 3093 |
| 3108 |
| 3111 |
| 3116 |
| 3120 |
| 3121 |
| 3124 |
| 3126 |
| 3130 |
| 4514 |
| 4519 |
| 4522 |
| 6761 |
| 6925 |
| 7067 |

Approximately 4030 gene modifying polypeptide candidates within the library had a Z-score of at least 1 or greater in any one of conditions 1, 2, 3, or 4 using this further analysis. These results show that this subset of gene modifying polypeptides had editing activity in at least one analyzed condition of the screening assay under this revised analysis. The subset of these gene modifying polypeptides are encoded by amino acid sequences of any one of the SEQ ID NOs listed in Table D6 below.

TABLE D6

Gene modifying polypeptide candidates having a Z-score of at least 1 or greater in any one of conditions 1, 2, 3, or 4.
SEQ ID NOs:

| | | | | | | | | | |
|---|---|---|---|---|---|---|---|---|---|
| 1 | 486 | 1065 | 1642 | 2097 | 2560 | 2994 | 6192 | 6784 | 7361 |
| 2 | 488 | 1066 | 1644 | 2098 | 2561 | 2995 | 6193 | 6785 | 7362 |
| 3 | 489 | 1067 | 1645 | 2099 | 2562 | 2997 | 6195 | 6786 | 7364 |

TABLE D6-continued

Gene modifying polypeptide candidates having a Z-score of at least 1 or greater in any one of conditions 1, 2, 3, or 4.
SEQ ID NOs:

| | | | | | | | | | |
|---|---|---|---|---|---|---|---|---|---|
| 4 | 495 | 1068 | 1646 | 2100 | 2563 | 2998 | 6196 | 6787 | 7368 |
| 5 | 499 | 1069 | 1648 | 2101 | 2564 | 2999 | 6197 | 6788 | 7369 |
| 6 | 502 | 1070 | 1649 | 2102 | 2565 | 3001 | 6200 | 6791 | 7370 |
| 7 | 503 | 1071 | 1651 | 2103 | 2566 | 3002 | 6201 | 6792 | 7371 |
| 9 | 504 | 1072 | 1652 | 2104 | 2567 | 3003 | 6203 | 6793 | 7372 |
| 10 | 510 | 1073 | 1653 | 2105 | 2568 | 3004 | 6204 | 6794 | 7374 |
| 12 | 517 | 1074 | 1654 | 2106 | 2569 | 3005 | 6205 | 6795 | 7375 |
| 13 | 522 | 1075 | 1655 | 2107 | 2570 | 3006 | 6206 | 6796 | 7377 |
| 14 | 523 | 1076 | 1656 | 2108 | 2571 | 3007 | 6207 | 6797 | 7378 |
| 17 | 524 | 1077 | 1657 | 2109 | 2572 | 3008 | 6208 | 6798 | 7379 |
| 18 | 527 | 1078 | 1658 | 2110 | 2573 | 3009 | 6210 | 6799 | 7380 |
| 19 | 532 | 1079 | 1659 | 2111 | 2574 | 3010 | 6212 | 6800 | 7381 |
| 22 | 534 | 1080 | 1660 | 2112 | 2575 | 3011 | 6213 | 6801 | 7382 |
| 24 | 535 | 1081 | 1661 | 2113 | 2576 | 3012 | 6214 | 6802 | 7384 |
| 28 | 536 | 1082 | 1662 | 2114 | 2577 | 3013 | 6215 | 6803 | 7386 |
| 33 | 537 | 1083 | 1663 | 2115 | 2578 | 3014 | 6216 | 6804 | 7387 |
| 34 | 538 | 1084 | 1664 | 2116 | 2579 | 3015 | 6217 | 6805 | 7388 |
| 35 | 539 | 1085 | 1665 | 2117 | 2580 | 3016 | 6218 | 6806 | 7389 |
| 36 | 540 | 1086 | 1666 | 2118 | 2581 | 3018 | 6219 | 6807 | 7390 |
| 37 | 541 | 1087 | 1667 | 2119 | 2582 | 3019 | 6222 | 6808 | 7391 |
| 38 | 542 | 1088 | 1668 | 2120 | 2583 | 3020 | 6223 | 6809 | 7392 |
| 39 | 543 | 1089 | 1669 | 2121 | 2584 | 3021 | 6226 | 6810 | 7393 |
| 40 | 544 | 1090 | 1670 | 2122 | 2585 | 3022 | 6227 | 6811 | 7394 |
| 41 | 545 | 1091 | 1671 | 2123 | 2586 | 3023 | 6229 | 6814 | 7396 |
| 42 | 546 | 1092 | 1672 | 2125 | 2587 | 3025 | 6234 | 6815 | 7397 |
| 43 | 547 | 1093 | 1673 | 2126 | 2588 | 3026 | 6235 | 6820 | 7398 |
| 44 | 548 | 1094 | 1674 | 2127 | 2589 | 3027 | 6236 | 6822 | 7400 |
| 45 | 549 | 1095 | 1675 | 2128 | 2590 | 3028 | 6237 | 6824 | 7402 |
| 46 | 550 | 1097 | 1676 | 2129 | 2591 | 3029 | 6239 | 6826 | 7403 |
| 47 | 553 | 1103 | 1677 | 2130 | 2592 | 3030 | 6240 | 6827 | 7404 |
| 48 | 554 | 1110 | 1678 | 2132 | 2593 | 3031 | 6241 | 6829 | 7406 |
| 49 | 555 | 1115 | 1679 | 2133 | 2594 | 3032 | 6243 | 6830 | 7409 |
| 50 | 556 | 1116 | 1680 | 2134 | 2595 | 3033 | 6244 | 6832 | 7412 |
| 51 | 557 | 1117 | 1681 | 2135 | 2596 | 3034 | 6245 | 6833 | 7413 |
| 52 | 558 | 1118 | 1682 | 2136 | 2597 | 3035 | 6247 | 6834 | 7414 |
| 53 | 559 | 1119 | 1683 | 2137 | 2598 | 3036 | 6248 | 6835 | 7415 |
| 54 | 560 | 1120 | 1684 | 2138 | 2599 | 3037 | 6249 | 6836 | 7416 |
| 55 | 561 | 1121 | 1685 | 2139 | 2600 | 3038 | 6250 | 6837 | 7417 |
| 56 | 562 | 1122 | 1686 | 2140 | 2601 | 3039 | 6253 | 6838 | 7418 |
| 57 | 563 | 1124 | 1687 | 2141 | 2602 | 3040 | 6254 | 6841 | 7419 |
| 58 | 564 | 1126 | 1688 | 2142 | 2603 | 3041 | 6255 | 6842 | 7420 |
| 59 | 565 | 1131 | 1689 | 2143 | 2604 | 3042 | 6257 | 6843 | 7424 |
| 60 | 566 | 1134 | 1690 | 2144 | 2605 | 3043 | 6258 | 6844 | 7426 |
| 61 | 567 | 1136 | 1691 | 2145 | 2606 | 3044 | 6261 | 6845 | 7427 |
| 62 | 568 | 1137 | 1692 | 2146 | 2607 | 3045 | 6263 | 6846 | 7428 |
| 63 | 570 | 1138 | 1693 | 2147 | 2608 | 3046 | 6264 | 6847 | 7430 |
| 64 | 571 | 1139 | 1694 | 2148 | 2610 | 3047 | 6265 | 6848 | 7431 |
| 65 | 572 | 1140 | 1695 | 2149 | 2611 | 3048 | 6266 | 6849 | 7432 |
| 66 | 575 | 1141 | 1696 | 2150 | 2612 | 3049 | 6267 | 6850 | 7433 |
| 67 | 581 | 1142 | 1697 | 2151 | 2613 | 3050 | 6268 | 6851 | 7434 |
| 68 | 583 | 1143 | 1698 | 2152 | 2614 | 3051 | 6269 | 6852 | 7435 |
| 69 | 584 | 1144 | 1699 | 2153 | 2615 | 3052 | 6271 | 6853 | 7436 |
| 70 | 585 | 1145 | 1700 | 2154 | 2616 | 3053 | 6272 | 6854 | 7438 |
| 71 | 587 | 1146 | 1701 | 2155 | 2617 | 3054 | 6273 | 6855 | 7441 |
| 72 | 589 | 1147 | 1702 | 2156 | 2618 | 3055 | 6275 | 6857 | 7442 |
| 73 | 590 | 1148 | 1703 | 2158 | 2619 | 3056 | 6277 | 6858 | 7443 |
| 74 | 591 | 1149 | 1704 | 2159 | 2620 | 3057 | 6278 | 6859 | 7444 |
| 75 | 592 | 1150 | 1705 | 2161 | 2621 | 3058 | 6279 | 6860 | 7445 |
| 76 | 593 | 1151 | 1706 | 2162 | 2622 | 3059 | 6280 | 6861 | 7446 |
| 77 | 594 | 1152 | 1707 | 2163 | 2623 | 3060 | 6281 | 6863 | 7448 |
| 78 | 595 | 1153 | 1708 | 2164 | 2624 | 3061 | 6282 | 6864 | 7449 |
| 79 | 596 | 1154 | 1709 | 2165 | 2625 | 3062 | 6284 | 6865 | 7450 |
| 80 | 597 | 1155 | 1710 | 2166 | 2626 | 3063 | 6285 | 6866 | 7451 |
| 81 | 598 | 1156 | 1711 | 2167 | 2627 | 3064 | 6286 | 6867 | 7452 |
| 82 | 599 | 1157 | 1712 | 2168 | 2628 | 3065 | 6287 | 6868 | 7453 |
| 83 | 600 | 1158 | 1713 | 2170 | 2629 | 3066 | 6288 | 6869 | 7455 |
| 84 | 601 | 1159 | 1714 | 2171 | 2630 | 3067 | 6290 | 6870 | 7457 |
| 85 | 602 | 1160 | 1715 | 2172 | 2631 | 3068 | 6292 | 6871 | 7458 |
| 86 | 604 | 1161 | 1716 | 2173 | 2632 | 3070 | 6293 | 6872 | 7461 |
| 87 | 605 | 1162 | 1717 | 2174 | 2633 | 3071 | 6294 | 6873 | 7462 |
| 88 | 606 | 1163 | 1718 | 2175 | 2634 | 3072 | 6295 | 6874 | 7464 |
| 89 | 607 | 1164 | 1719 | 2176 | 2635 | 3073 | 6298 | 6876 | 7466 |
| 90 | 610 | 1165 | 1720 | 2177 | 2636 | 3074 | 6299 | 6877 | 7467 |
| 91 | 611 | 1166 | 1721 | 2178 | 2637 | 3075 | 6302 | 6878 | 7469 |
| 92 | 614 | 1167 | 1722 | 2179 | 2638 | 3076 | 6304 | 6879 | 7470 |
| 94 | 616 | 1168 | 1723 | 2180 | 2639 | 3077 | 6305 | 6880 | 7471 |

TABLE D6-continued

Gene modifying polypeptide candidates having a Z-score of at least 1 or greater in any one of conditions 1, 2, 3, or 4.
SEQ ID NOs:

| | | | | | | | | | |
|---|---|---|---|---|---|---|---|---|---|
| 95 | 617 | 1169 | 1724 | 2181 | 2640 | 3078 | 6306 | 6881 | 7472 |
| 96 | 618 | 1170 | 1725 | 2182 | 2641 | 3079 | 6307 | 6882 | 7473 |
| 97 | 624 | 1171 | 1726 | 2183 | 2642 | 3080 | 6308 | 6883 | 7474 |
| 98 | 625 | 1172 | 1728 | 2184 | 2643 | 3081 | 6309 | 6885 | 7475 |
| 99 | 626 | 1173 | 1729 | 2185 | 2644 | 3082 | 6310 | 6886 | 7476 |
| 100 | 628 | 1174 | 1730 | 2186 | 2645 | 3083 | 6311 | 6890 | 7477 |
| 101 | 631 | 1176 | 1731 | 2188 | 2646 | 3084 | 6312 | 6891 | 7479 |
| 102 | 632 | 1177 | 1733 | 2189 | 2647 | 3085 | 6313 | 6892 | 7483 |
| 103 | 633 | 1178 | 1734 | 2190 | 2648 | 3086 | 6314 | 6893 | 7484 |
| 104 | 634 | 1181 | 1735 | 2191 | 2649 | 3087 | 6315 | 6894 | 7485 |
| 105 | 636 | 1182 | 1736 | 2192 | 2650 | 3088 | 6316 | 6895 | 7488 |
| 106 | 640 | 1184 | 1737 | 2193 | 2651 | 3089 | 6317 | 6896 | 7489 |
| 107 | 645 | 1185 | 1738 | 2194 | 2652 | 3090 | 6319 | 6897 | 7491 |
| 108 | 647 | 1186 | 1739 | 2195 | 2653 | 3091 | 6320 | 6898 | 7492 |
| 110 | 648 | 1187 | 1740 | 2196 | 2654 | 3092 | 6321 | 6899 | 7493 |
| 112 | 649 | 1188 | 1741 | 2197 | 2655 | 3093 | 6322 | 6900 | 7494 |
| 113 | 650 | 1190 | 1742 | 2198 | 2656 | 3094 | 6324 | 6902 | 7495 |
| 114 | 652 | 1193 | 1743 | 2199 | 2657 | 3095 | 6325 | 6903 | 7496 |
| 115 | 653 | 1197 | 1744 | 2200 | 2658 | 3096 | 6326 | 6906 | 7497 |
| 116 | 654 | 1198 | 1745 | 2201 | 2659 | 3097 | 6327 | 6907 | 7499 |
| 117 | 655 | 1199 | 1747 | 2202 | 2660 | 3098 | 6328 | 6908 | 7500 |
| 118 | 656 | 1200 | 1748 | 2203 | 2661 | 3099 | 6329 | 6910 | 7501 |
| 119 | 657 | 1201 | 1750 | 2204 | 2662 | 3100 | 6331 | 6911 | 7502 |
| 120 | 659 | 1202 | 1751 | 2205 | 2663 | 3101 | 6334 | 6913 | 7503 |
| 121 | 660 | 1203 | 1752 | 2206 | 2664 | 3102 | 6335 | 6915 | 7505 |
| 122 | 661 | 1204 | 1753 | 2207 | 2665 | 3103 | 6336 | 6917 | 7507 |
| 123 | 662 | 1205 | 1754 | 2210 | 2666 | 3104 | 6337 | 6918 | 7508 |
| 124 | 663 | 1206 | 1755 | 2211 | 2667 | 3105 | 6338 | 6919 | 7509 |
| 125 | 664 | 1207 | 1756 | 2212 | 2668 | 3106 | 6339 | 6920 | 7510 |
| 126 | 666 | 1208 | 1757 | 2213 | 2669 | 3107 | 6340 | 6921 | 7511 |
| 127 | 667 | 1209 | 1758 | 2214 | 2670 | 3108 | 6343 | 6923 | 7512 |
| 128 | 668 | 1210 | 1759 | 2218 | 2671 | 3109 | 6344 | 6924 | 7513 |
| 129 | 669 | 1211 | 1760 | 2219 | 2672 | 3110 | 6345 | 6925 | 7514 |
| 130 | 670 | 1212 | 1761 | 2222 | 2673 | 3111 | 6347 | 6928 | 7515 |
| 131 | 673 | 1213 | 1762 | 2223 | 2674 | 3112 | 6349 | 6929 | 7516 |
| 132 | 677 | 1214 | 1764 | 2224 | 2675 | 3113 | 6350 | 6930 | 7517 |
| 133 | 678 | 1215 | 1765 | 2225 | 2676 | 3114 | 6351 | 6931 | 7518 |
| 134 | 679 | 1216 | 1766 | 2226 | 2677 | 3115 | 6352 | 6932 | 7519 |
| 135 | 680 | 1217 | 1767 | 2227 | 2678 | 3116 | 6353 | 6933 | 7520 |
| 136 | 681 | 1218 | 1769 | 2228 | 2679 | 3117 | 6355 | 6934 | 7521 |
| 137 | 684 | 1219 | 1770 | 2229 | 2680 | 3118 | 6356 | 6939 | 7523 |
| 138 | 687 | 1220 | 1771 | 2230 | 2681 | 3119 | 6357 | 6942 | 7525 |
| 139 | 689 | 1221 | 1772 | 2231 | 2682 | 3120 | 6358 | 6943 | 7526 |
| 140 | 690 | 1222 | 1773 | 2232 | 2683 | 3121 | 6359 | 6944 | 7528 |
| 141 | 692 | 1223 | 1774 | 2233 | 2684 | 3122 | 6360 | 6947 | 7529 |
| 142 | 694 | 1224 | 1775 | 2234 | 2685 | 3123 | 6363 | 6948 | 7530 |
| 143 | 700 | 1225 | 1776 | 2235 | 2686 | 3124 | 6364 | 6950 | 7532 |
| 144 | 702 | 1226 | 1777 | 2236 | 2687 | 3125 | 6366 | 6951 | 7534 |
| 145 | 706 | 1227 | 1778 | 2237 | 2688 | 3126 | 6367 | 6952 | 7535 |
| 146 | 711 | 1228 | 1779 | 2238 | 2689 | 3127 | 6368 | 6953 | 7536 |
| 147 | 715 | 1229 | 1780 | 2239 | 2690 | 3128 | 6369 | 6954 | 7537 |
| 148 | 716 | 1230 | 1781 | 2240 | 2691 | 3129 | 6370 | 6957 | 7538 |
| 149 | 717 | 1231 | 1782 | 2241 | 2692 | 3130 | 6372 | 6961 | 7540 |
| 150 | 719 | 1232 | 1783 | 2242 | 2693 | 3131 | 6374 | 6962 | 7541 |
| 151 | 720 | 1233 | 1784 | 2244 | 2694 | 3132 | 6377 | 6965 | 7542 |
| 152 | 724 | 1234 | 1785 | 2245 | 2695 | 3133 | 6378 | 6966 | 7545 |
| 153 | 726 | 1235 | 1786 | 2246 | 2696 | 3134 | 6379 | 6968 | 7547 |
| 154 | 727 | 1236 | 1787 | 2247 | 2697 | 3135 | 6380 | 6969 | 7548 |
| 155 | 729 | 1237 | 1788 | 2248 | 2698 | 3136 | 6381 | 6970 | 7549 |
| 156 | 731 | 1238 | 1789 | 2249 | 2699 | 3138 | 6383 | 6971 | 7550 |
| 157 | 738 | 1239 | 1790 | 2250 | 2700 | 3139 | 6384 | 6972 | 7555 |
| 158 | 739 | 1240 | 1792 | 2251 | 2701 | 3141 | 6385 | 6973 | 7556 |
| 159 | 740 | 1241 | 1793 | 2252 | 2702 | 3142 | 6389 | 6974 | 7558 |
| 160 | 745 | 1242 | 1794 | 2253 | 2703 | 3144 | 6390 | 6976 | 7560 |
| 161 | 747 | 1243 | 1795 | 2254 | 2704 | 3146 | 6393 | 6978 | 7561 |
| 162 | 755 | 1244 | 1796 | 2255 | 2708 | 3147 | 6394 | 6979 | 7562 |
| 163 | 756 | 1245 | 1797 | 2256 | 2709 | 3152 | 6395 | 6980 | 7563 |
| 164 | 759 | 1246 | 1799 | 2257 | 2710 | 3153 | 6396 | 6982 | 7564 |
| 165 | 765 | 1247 | 1800 | 2259 | 2711 | 3154 | 6397 | 6984 | 7565 |
| 166 | 766 | 1248 | 1801 | 2260 | 2712 | 3155 | 6398 | 6985 | 7566 |
| 167 | 767 | 1249 | 1802 | 2261 | 2713 | 3157 | 6399 | 6989 | 7567 |
| 168 | 768 | 1250 | 1803 | 2262 | 2714 | 3162 | 6400 | 6990 | 7568 |
| 169 | 769 | 1251 | 1804 | 2263 | 2715 | 3163 | 6401 | 6993 | 7569 |
| 170 | 770 | 1252 | 1805 | 2264 | 2716 | 3166 | 6402 | 6996 | 7570 |
| 171 | 771 | 1253 | 1806 | 2265 | 2717 | 3167 | 6403 | 6998 | 7574 |
| 172 | 772 | 1254 | 1808 | 2266 | 2718 | 3169 | 6404 | 6999 | 7575 |

TABLE D6-continued

Gene modifying polypeptide candidates having a Z-score of at least 1 or greater in any one of conditions 1, 2, 3, or 4.
SEQ ID NOs:

| | | | | | | | | | |
|---|---|---|---|---|---|---|---|---|---|
| 173 | 773 | 1255 | 1809 | 2268 | 2719 | 3171 | 6406 | 7001 | 7576 |
| 174 | 774 | 1256 | 1810 | 2270 | 2720 | 3172 | 6407 | 7002 | 7579 |
| 175 | 775 | 1257 | 1811 | 2271 | 2721 | 3173 | 6409 | 7003 | 7580 |
| 176 | 776 | 1258 | 1812 | 2272 | 2722 | 3175 | 6410 | 7004 | 7581 |
| 177 | 780 | 1259 | 1813 | 2273 | 2723 | 3176 | 6411 | 7005 | 7582 |
| 178 | 781 | 1261 | 1815 | 2274 | 2724 | 3177 | 6412 | 7006 | 7585 |
| 179 | 782 | 1262 | 1816 | 2275 | 2725 | 3180 | 6415 | 7007 | 7586 |
| 180 | 783 | 1263 | 1818 | 2276 | 2726 | 3181 | 6417 | 7008 | 7587 |
| 181 | 784 | 1264 | 1819 | 2277 | 2727 | 3183 | 6418 | 7009 | 7588 |
| 182 | 785 | 1265 | 1824 | 2278 | 2728 | 3184 | 6419 | 7012 | 7590 |
| 183 | 789 | 1266 | 1825 | 2279 | 2729 | 3188 | 6420 | 7013 | 7591 |
| 184 | 790 | 1267 | 1827 | 2280 | 2730 | 3190 | 6421 | 7014 | 7592 |
| 185 | 794 | 1268 | 1828 | 2281 | 2731 | 3196 | 6423 | 7015 | 7595 |
| 186 | 797 | 1269 | 1829 | 2282 | 2732 | 3198 | 6424 | 7016 | 7596 |
| 187 | 798 | 1270 | 1831 | 2286 | 2733 | 3199 | 6425 | 7017 | 7597 |
| 188 | 799 | 1271 | 1832 | 2287 | 2734 | 3201 | 6426 | 7020 | 7599 |
| 190 | 800 | 1272 | 1834 | 2288 | 2735 | 3202 | 6427 | 7021 | 7600 |
| 191 | 801 | 1273 | 1835 | 2289 | 2736 | 3203 | 6431 | 7023 | 7603 |
| 192 | 802 | 1274 | 1838 | 2291 | 2737 | 3204 | 6432 | 7024 | 7606 |
| 193 | 803 | 1275 | 1840 | 2293 | 2738 | 3205 | 6433 | 7025 | 7607 |
| 194 | 804 | 1276 | 1842 | 2294 | 2739 | 3206 | 6434 | 7026 | 7610 |
| 195 | 805 | 1277 | 1843 | 2295 | 2740 | 3207 | 6435 | 7027 | 7612 |
| 196 | 806 | 1278 | 1844 | 2299 | 2741 | 3208 | 6437 | 7028 | 7613 |
| 197 | 807 | 1279 | 1845 | 2300 | 2742 | 3209 | 6439 | 7030 | 7615 |
| 198 | 808 | 1280 | 1846 | 2301 | 2743 | 3211 | 6440 | 7031 | 7620 |
| 199 | 809 | 1282 | 1847 | 2302 | 2744 | 3213 | 6441 | 7032 | 7621 |
| 200 | 810 | 1288 | 1848 | 2303 | 2745 | 3214 | 6442 | 7033 | 7622 |
| 201 | 811 | 1290 | 1849 | 2304 | 2746 | 3218 | 6443 | 7034 | 7624 |
| 202 | 812 | 1295 | 1850 | 2305 | 2747 | 3219 | 6444 | 7035 | 7625 |
| 203 | 813 | 1296 | 1851 | 2306 | 2748 | 3220 | 6445 | 7036 | 7626 |
| 204 | 814 | 1298 | 1852 | 2307 | 2750 | 3223 | 6446 | 7037 | 7627 |
| 205 | 815 | 1299 | 1853 | 2308 | 2751 | 3225 | 6448 | 7038 | 7628 |
| 206 | 816 | 1301 | 1855 | 2309 | 2752 | 3228 | 6449 | 7040 | 7629 |
| 207 | 817 | 1302 | 1856 | 2310 | 2753 | 3233 | 6451 | 7043 | 7631 |
| 208 | 818 | 1304 | 1857 | 2311 | 2754 | 3234 | 6453 | 7045 | 7632 |
| 209 | 819 | 1305 | 1858 | 2312 | 2755 | 3235 | 6454 | 7046 | 7633 |
| 210 | 820 | 1308 | 1859 | 2313 | 2756 | 3240 | 6455 | 7047 | 7634 |
| 211 | 821 | 1311 | 1860 | 2314 | 2757 | 3247 | 6456 | 7049 | 7635 |
| 212 | 822 | 1312 | 1861 | 2315 | 2758 | 3248 | 6457 | 7050 | 7636 |
| 213 | 823 | 1314 | 1862 | 2316 | 2759 | 3251 | 6458 | 7051 | 7638 |
| 214 | 824 | 1315 | 1863 | 2317 | 2760 | 3252 | 6459 | 7052 | 7643 |
| 215 | 825 | 1320 | 1864 | 2318 | 2761 | 3253 | 6460 | 7053 | 7644 |
| 216 | 826 | 1322 | 1865 | 2319 | 2762 | 3254 | 6461 | 7054 | 7645 |
| 217 | 827 | 1324 | 1866 | 2320 | 2763 | 3256 | 6462 | 7055 | 7646 |
| 218 | 828 | 1326 | 1867 | 2321 | 2764 | 3259 | 6463 | 7056 | 7649 |
| 219 | 829 | 1327 | 1868 | 2322 | 2765 | 3260 | 6465 | 7058 | 7650 |
| 220 | 830 | 1328 | 1869 | 2323 | 2766 | 3261 | 6467 | 7059 | 7651 |
| 221 | 831 | 1329 | 1870 | 2324 | 2767 | 3262 | 6469 | 7060 | 7652 |
| 222 | 832 | 1338 | 1871 | 2325 | 2768 | 3263 | 6473 | 7062 | 7653 |
| 223 | 833 | 1340 | 1872 | 2326 | 2769 | 3264 | 6474 | 7063 | 7654 |
| 224 | 834 | 1342 | 1873 | 2327 | 2770 | 3265 | 6475 | 7064 | 7656 |
| 225 | 835 | 1346 | 1874 | 2328 | 2771 | 3266 | 6476 | 7065 | 7657 |
| 226 | 836 | 1347 | 1875 | 2329 | 2772 | 3268 | 6477 | 7067 | 7658 |
| 227 | 837 | 1348 | 1876 | 2330 | 2773 | 3269 | 6478 | 7068 | 7659 |
| 228 | 839 | 1349 | 1877 | 2331 | 2774 | 3270 | 6479 | 7070 | 7660 |
| 229 | 840 | 1350 | 1878 | 2332 | 2775 | 3272 | 6480 | 7072 | 7662 |
| 230 | 841 | 1351 | 1879 | 2333 | 2776 | 3276 | 6484 | 7073 | 7663 |
| 231 | 842 | 1354 | 1880 | 2334 | 2778 | 3277 | 6486 | 7074 | 7665 |
| 232 | 843 | 1357 | 1881 | 2335 | 2779 | 3279 | 6488 | 7075 | 7666 |
| 233 | 844 | 1359 | 1882 | 2336 | 2780 | 3282 | 6490 | 7077 | 7667 |
| 234 | 845 | 1362 | 1883 | 2337 | 2781 | 3283 | 6491 | 7078 | 7668 |
| 235 | 846 | 1365 | 1884 | 2338 | 2782 | 3286 | 6492 | 7079 | 7669 |
| 236 | 847 | 1366 | 1885 | 2339 | 2783 | 3294 | 6493 | 7080 | 7670 |
| 237 | 848 | 1369 | 1886 | 2340 | 2784 | 3296 | 6495 | 7081 | 7674 |
| 238 | 849 | 1370 | 1887 | 2341 | 2785 | 3298 | 6496 | 7082 | 7675 |
| 239 | 850 | 1371 | 1888 | 2342 | 2786 | 3299 | 6497 | 7083 | 7676 |
| 240 | 852 | 1372 | 1889 | 2343 | 2787 | 3300 | 6499 | 7084 | 7677 |
| 241 | 853 | 1373 | 1890 | 2344 | 2788 | 3302 | 6501 | 7085 | 7678 |
| 242 | 854 | 1374 | 1891 | 2345 | 2789 | 3303 | 6502 | 7087 | 7679 |
| 243 | 855 | 1375 | 1892 | 2346 | 2790 | 3305 | 6503 | 7088 | 7681 |
| 244 | 856 | 1376 | 1893 | 2347 | 2791 | 3306 | 6505 | 7089 | 7682 |
| 245 | 857 | 1377 | 1894 | 2348 | 2792 | 3310 | 6506 | 7090 | 7685 |
| 246 | 860 | 1378 | 1895 | 2349 | 2793 | 3313 | 6507 | 7091 | 7686 |
| 247 | 861 | 1379 | 1896 | 2350 | 2794 | 3315 | 6509 | 7092 | 7689 |
| 248 | 862 | 1380 | 1897 | 2351 | 2795 | 3316 | 6510 | 7093 | 7693 |
| 249 | 863 | 1381 | 1898 | 2352 | 2796 | 3318 | 6511 | 7095 | 7694 |

TABLE D6-continued

Gene modifying polypeptide candidates having a Z-score of at least 1 or greater in any one of conditions 1, 2, 3, or 4.
SEQ ID NOs:

| | | | | | | | | |
|---|---|---|---|---|---|---|---|---|
| 250 | 866 | 1382 | 1899 | 2353 | 2797 | 3323 | 6512 | 7096 | 7695 |
| 251 | 867 | 1383 | 1900 | 2354 | 2798 | 3326 | 6515 | 7097 | 7698 |
| 252 | 868 | 1384 | 1901 | 2355 | 2799 | 3329 | 6522 | 7098 | 7700 |
| 253 | 869 | 1385 | 1902 | 2356 | 2800 | 4501 | 6524 | 7099 | 7701 |
| 254 | 870 | 1386 | 1903 | 2357 | 2801 | 4502 | 6525 | 7100 | 7702 |
| 255 | 871 | 1387 | 1904 | 2358 | 2802 | 4503 | 6526 | 7103 | 7705 |
| 256 | 872 | 1388 | 1905 | 2359 | 2803 | 4504 | 6527 | 7104 | 7706 |
| 257 | 873 | 1389 | 1906 | 2360 | 2804 | 4505 | 6529 | 7105 | 7707 |
| 258 | 874 | 1390 | 1907 | 2361 | 2805 | 4506 | 6530 | 7106 | 7708 |
| 259 | 875 | 1391 | 1908 | 2362 | 2806 | 4507 | 6531 | 7109 | 7713 |
| 261 | 876 | 1392 | 1909 | 2363 | 2807 | 4508 | 6532 | 7110 | 7715 |
| 262 | 877 | 1393 | 1910 | 2364 | 2808 | 4509 | 6533 | 7111 | 7717 |
| 263 | 878 | 1394 | 1911 | 2365 | 2809 | 4510 | 6535 | 7112 | 7718 |
| 264 | 879 | 1395 | 1912 | 2366 | 2810 | 4511 | 6538 | 7114 | 7719 |
| 265 | 880 | 1396 | 1913 | 2367 | 2811 | 4512 | 6540 | 7115 | 7720 |
| 266 | 881 | 1397 | 1914 | 2368 | 2812 | 4513 | 6541 | 7116 | 7721 |
| 267 | 882 | 1398 | 1915 | 2369 | 2813 | 4514 | 6542 | 7118 | 7722 |
| 268 | 883 | 1399 | 1916 | 2370 | 2814 | 4515 | 6543 | 7119 | 7723 |
| 269 | 884 | 1400 | 1917 | 2371 | 2815 | 4516 | 6544 | 7120 | 7724 |
| 270 | 885 | 1401 | 1918 | 2372 | 2816 | 4517 | 6545 | 7121 | 7726 |
| 271 | 886 | 1402 | 1919 | 2373 | 2817 | 4518 | 6547 | 7123 | 7727 |
| 272 | 887 | 1403 | 1920 | 2374 | 2818 | 4519 | 6548 | 7125 | 7728 |
| 273 | 888 | 1404 | 1921 | 2375 | 2819 | 4520 | 6549 | 7127 | 7729 |
| 274 | 889 | 1405 | 1922 | 2376 | 2820 | 4521 | 6551 | 7128 | 7730 |
| 275 | 890 | 1406 | 1923 | 2377 | 2821 | 4522 | 6552 | 7129 | 7731 |
| 276 | 891 | 1407 | 1924 | 2378 | 2822 | 4523 | 6554 | 7131 | 7732 |
| 277 | 892 | 1408 | 1925 | 2379 | 2823 | 4524 | 6555 | 7133 | 7733 |
| 278 | 893 | 1409 | 1926 | 2380 | 2824 | 4525 | 6557 | 7134 | 7734 |
| 279 | 894 | 1410 | 1927 | 2381 | 2825 | 4526 | 6559 | 7135 | 7735 |
| 280 | 895 | 1411 | 1928 | 2382 | 2826 | 4527 | 6561 | 7136 | 7737 |
| 281 | 896 | 1412 | 1929 | 2383 | 2827 | 4528 | 6563 | 7140 | 7738 |
| 283 | 897 | 1413 | 1931 | 2384 | 2828 | 4529 | 6564 | 7141 | 7739 |
| 284 | 898 | 1414 | 1932 | 2385 | 2829 | 4530 | 6565 | 7142 | 7740 |
| 285 | 899 | 1415 | 1933 | 2386 | 2830 | 4531 | 6566 | 7143 | 7741 |
| 286 | 900 | 1416 | 1934 | 2387 | 2831 | 4532 | 6567 | 7144 | |
| 287 | 901 | 1417 | 1935 | 2388 | 2832 | 4533 | 6568 | 7147 | |
| 290 | 902 | 1418 | 1936 | 2389 | 2833 | 4534 | 6569 | 7148 | |
| 293 | 903 | 1419 | 1937 | 2390 | 2834 | 4535 | 6572 | 7149 | |
| 294 | 904 | 1420 | 1938 | 2391 | 2835 | 4536 | 6573 | 7150 | |
| 295 | 905 | 1421 | 1939 | 2392 | 2836 | 4537 | 6575 | 7151 | |
| 296 | 906 | 1422 | 1940 | 2393 | 2837 | 4538 | 6577 | 7152 | |
| 297 | 907 | 1423 | 1941 | 2394 | 2838 | 4539 | 6579 | 7153 | |
| 298 | 908 | 1424 | 1942 | 2395 | 2839 | 4540 | 6580 | 7154 | |
| 299 | 909 | 1425 | 1943 | 2396 | 2840 | 4541 | 6581 | 7155 | |
| 300 | 910 | 1426 | 1944 | 2397 | 2841 | 6001 | 6582 | 7156 | |
| 301 | 911 | 1427 | 1945 | 2398 | 2842 | 6004 | 6583 | 7158 | |
| 302 | 912 | 1428 | 1946 | 2399 | 2843 | 6006 | 6584 | 7159 | |
| 303 | 913 | 1429 | 1947 | 2400 | 2844 | 6007 | 6585 | 7160 | |
| 304 | 914 | 1430 | 1948 | 2401 | 2845 | 6008 | 6586 | 7161 | |
| 305 | 915 | 1431 | 1949 | 2402 | 2846 | 6010 | 6587 | 7162 | |
| 306 | 916 | 1432 | 1950 | 2403 | 2847 | 6011 | 6588 | 7163 | |
| 307 | 917 | 1433 | 1951 | 2404 | 2848 | 6012 | 6589 | 7164 | |
| 308 | 918 | 1434 | 1952 | 2405 | 2849 | 6013 | 6590 | 7166 | |
| 309 | 919 | 1435 | 1953 | 2406 | 2850 | 6014 | 6591 | 7167 | |
| 310 | 920 | 1436 | 1954 | 2407 | 2851 | 6015 | 6593 | 7168 | |
| 312 | 921 | 1437 | 1955 | 2408 | 2852 | 6017 | 6594 | 7169 | |
| 313 | 922 | 1439 | 1956 | 2409 | 2853 | 6018 | 6595 | 7170 | |
| 314 | 923 | 1440 | 1957 | 2410 | 2854 | 6019 | 6596 | 7171 | |
| 315 | 924 | 1441 | 1958 | 2411 | 2855 | 6021 | 6597 | 7172 | |
| 316 | 925 | 1442 | 1959 | 2412 | 2856 | 6022 | 6598 | 7174 | |
| 317 | 926 | 1443 | 1960 | 2413 | 2857 | 6023 | 6599 | 7175 | |
| 318 | 927 | 1444 | 1961 | 2414 | 2858 | 6024 | 6600 | 7176 | |
| 319 | 928 | 1445 | 1962 | 2415 | 2859 | 6025 | 6601 | 7177 | |
| 320 | 929 | 1446 | 1963 | 2416 | 2860 | 6026 | 6602 | 7179 | |
| 321 | 930 | 1447 | 1964 | 2417 | 2861 | 6028 | 6603 | 7180 | |
| 322 | 931 | 1448 | 1965 | 2418 | 2862 | 6029 | 6605 | 7181 | |
| 323 | 932 | 1449 | 1966 | 2419 | 2863 | 6030 | 6606 | 7183 | |
| 324 | 933 | 1450 | 1967 | 2420 | 2864 | 6031 | 6607 | 7184 | |
| 325 | 934 | 1451 | 1968 | 2422 | 2865 | 6033 | 6608 | 7186 | |
| 326 | 936 | 1452 | 1969 | 2423 | 2866 | 6035 | 6609 | 7187 | |
| 327 | 937 | 1455 | 1970 | 2424 | 2867 | 6036 | 6610 | 7188 | |
| 328 | 938 | 1456 | 1971 | 2425 | 2868 | 6038 | 6611 | 7191 | |
| 329 | 939 | 1460 | 1972 | 2426 | 2869 | 6040 | 6612 | 7192 | |
| 330 | 940 | 1462 | 1973 | 2427 | 2870 | 6041 | 6613 | 7194 | |
| 331 | 941 | 1471 | 1974 | 2431 | 2871 | 6043 | 6614 | 7195 | |
| 332 | 942 | 1473 | 1975 | 2436 | 2872 | 6045 | 6615 | 7196 | |

TABLE D6-continued

Gene modifying polypeptide candidates having a Z-score of at least 1 or greater in any one of conditions 1, 2, 3, or 4.
SEQ ID NOs:

| | | | | | | | |
|---|---|---|---|---|---|---|---|
| 333 | 943 | 1475 | 1976 | 2438 | 2873 | 6046 | 6617 | 7197 |
| 334 | 944 | 1488 | 1977 | 2440 | 2874 | 6048 | 6618 | 7198 |
| 335 | 945 | 1489 | 1978 | 2441 | 2875 | 6049 | 6619 | 7201 |
| 336 | 946 | 1491 | 1979 | 2442 | 2876 | 6050 | 6621 | 7203 |
| 337 | 948 | 1492 | 1980 | 2443 | 2877 | 6051 | 6622 | 7204 |
| 338 | 950 | 1493 | 1981 | 2444 | 2878 | 6054 | 6623 | 7206 |
| 339 | 951 | 1497 | 1982 | 2445 | 2880 | 6055 | 6624 | 7208 |
| 340 | 952 | 1499 | 1983 | 2446 | 2881 | 6056 | 6625 | 7209 |
| 341 | 957 | 1504 | 1984 | 2447 | 2882 | 6057 | 6627 | 7210 |
| 342 | 958 | 1505 | 1985 | 2448 | 2884 | 6058 | 6628 | 7212 |
| 343 | 959 | 1506 | 1986 | 2449 | 2885 | 6059 | 6629 | 7214 |
| 344 | 960 | 1507 | 1987 | 2450 | 2886 | 6060 | 6630 | 7215 |
| 345 | 961 | 1508 | 1988 | 2451 | 2887 | 6061 | 6632 | 7216 |
| 346 | 962 | 1510 | 1989 | 2452 | 2888 | 6063 | 6635 | 7217 |
| 347 | 963 | 1513 | 1990 | 2453 | 2889 | 6064 | 6637 | 7218 |
| 348 | 964 | 1515 | 1991 | 2454 | 2890 | 6066 | 6639 | 7220 |
| 349 | 965 | 1519 | 1992 | 2455 | 2891 | 6067 | 6642 | 7221 |
| 350 | 966 | 1521 | 1993 | 2456 | 2892 | 6068 | 6644 | 7222 |
| 351 | 967 | 1523 | 1994 | 2457 | 2893 | 6069 | 6645 | 7223 |
| 352 | 968 | 1524 | 1995 | 2458 | 2894 | 6071 | 6646 | 7226 |
| 353 | 969 | 1527 | 1996 | 2459 | 2895 | 6072 | 6648 | 7227 |
| 354 | 970 | 1529 | 1997 | 2460 | 2896 | 6073 | 6650 | 7228 |
| 355 | 971 | 1531 | 1998 | 2461 | 2897 | 6074 | 6651 | 7230 |
| 356 | 972 | 1539 | 1999 | 2462 | 2898 | 6075 | 6652 | 7231 |
| 357 | 973 | 1540 | 2000 | 2463 | 2899 | 6076 | 6654 | 7232 |
| 358 | 974 | 1541 | 2001 | 2464 | 2900 | 6079 | 6655 | 7233 |
| 359 | 975 | 1542 | 2002 | 2465 | 2901 | 6080 | 6656 | 7235 |
| 360 | 976 | 1543 | 2003 | 2466 | 2902 | 6081 | 6659 | 7236 |
| 361 | 977 | 1544 | 2004 | 2467 | 2903 | 6082 | 6661 | 7237 |
| 362 | 978 | 1545 | 2005 | 2468 | 2904 | 6083 | 6664 | 7238 |
| 363 | 979 | 1546 | 2006 | 2469 | 2905 | 6084 | 6665 | 7239 |
| 364 | 980 | 1547 | 2007 | 2470 | 2906 | 6085 | 6666 | 7240 |
| 365 | 981 | 1548 | 2008 | 2471 | 2907 | 6088 | 6669 | 7242 |
| 366 | 982 | 1549 | 2009 | 2472 | 2908 | 6089 | 6671 | 7243 |
| 367 | 983 | 1550 | 2010 | 2473 | 2909 | 6090 | 6672 | 7244 |
| 368 | 984 | 1551 | 2011 | 2474 | 2910 | 6091 | 6674 | 7246 |
| 369 | 985 | 1552 | 2012 | 2476 | 2911 | 6092 | 6675 | 7247 |
| 370 | 986 | 1553 | 2013 | 2477 | 2912 | 6093 | 6676 | 7250 |
| 371 | 987 | 1554 | 2014 | 2478 | 2913 | 6094 | 6679 | 7251 |
| 372 | 988 | 1555 | 2015 | 2479 | 2914 | 6096 | 6680 | 7252 |
| 373 | 989 | 1556 | 2016 | 2480 | 2915 | 6097 | 6681 | 7253 |
| 374 | 990 | 1557 | 2017 | 2481 | 2916 | 6099 | 6683 | 7255 |
| 375 | 991 | 1558 | 2018 | 2482 | 2917 | 6101 | 6684 | 7258 |
| 376 | 992 | 1559 | 2019 | 2483 | 2918 | 6102 | 6685 | 7260 |
| 377 | 993 | 1560 | 2020 | 2484 | 2919 | 6103 | 6686 | 7261 |
| 379 | 994 | 1561 | 2021 | 2485 | 2920 | 6105 | 6687 | 7262 |
| 380 | 996 | 1563 | 2022 | 2488 | 2921 | 6106 | 6688 | 7263 |
| 381 | 997 | 1564 | 2023 | 2489 | 2922 | 6107 | 6689 | 7264 |
| 382 | 999 | 1565 | 2024 | 2490 | 2923 | 6108 | 6690 | 7265 |
| 383 | 1000 | 1566 | 2025 | 2491 | 2924 | 6109 | 6691 | 7266 |
| 384 | 1001 | 1567 | 2026 | 2492 | 2925 | 6110 | 6692 | 7267 |
| 385 | 1003 | 1568 | 2027 | 2497 | 2926 | 6112 | 6693 | 7270 |
| 386 | 1004 | 1570 | 2028 | 2498 | 2927 | 6115 | 6694 | 7273 |
| 387 | 1006 | 1571 | 2029 | 2501 | 2928 | 6116 | 6695 | 7274 |
| 388 | 1007 | 1572 | 2030 | 2502 | 2929 | 6117 | 6698 | 7275 |
| 389 | 1008 | 1573 | 2031 | 2503 | 2930 | 6118 | 6703 | 7276 |
| 390 | 1009 | 1574 | 2032 | 2504 | 2931 | 6121 | 6705 | 7278 |
| 391 | 1010 | 1575 | 2033 | 2505 | 2932 | 6122 | 6706 | 7281 |
| 392 | 1011 | 1576 | 2034 | 2506 | 2933 | 6123 | 6708 | 7282 |
| 393 | 1012 | 1577 | 2035 | 2507 | 2934 | 6124 | 6709 | 7284 |
| 394 | 1013 | 1578 | 2036 | 2508 | 2935 | 6125 | 6713 | 7286 |
| 395 | 1014 | 1579 | 2037 | 2509 | 2936 | 6129 | 6715 | 7288 |
| 396 | 1015 | 1580 | 2038 | 2510 | 2937 | 6130 | 6716 | 7289 |
| 397 | 1016 | 1581 | 2039 | 2511 | 2938 | 6131 | 6717 | 7291 |
| 398 | 1017 | 1582 | 2040 | 2512 | 2939 | 6133 | 6718 | 7292 |
| 399 | 1018 | 1583 | 2041 | 2513 | 2940 | 6136 | 6719 | 7293 |
| 400 | 1019 | 1584 | 2042 | 2514 | 2941 | 6137 | 6720 | 7294 |
| 401 | 1020 | 1585 | 2043 | 2515 | 2942 | 6138 | 6722 | 7297 |
| 402 | 1021 | 1587 | 2044 | 2516 | 2943 | 6139 | 6723 | 7298 |
| 403 | 1022 | 1588 | 2045 | 2517 | 2944 | 6140 | 6724 | 7299 |
| 404 | 1023 | 1590 | 2046 | 2518 | 2945 | 6141 | 6726 | 7301 |
| 405 | 1024 | 1592 | 2047 | 2519 | 2946 | 6142 | 6728 | 7302 |
| 406 | 1025 | 1593 | 2048 | 2520 | 2947 | 6143 | 6730 | 7303 |
| 407 | 1026 | 1594 | 2049 | 2521 | 2948 | 6144 | 6731 | 7304 |
| 408 | 1027 | 1597 | 2050 | 2522 | 2949 | 6147 | 6732 | 7305 |
| 409 | 1028 | 1598 | 2051 | 2523 | 2950 | 6148 | 6733 | 7306 |

TABLE D6-continued

Gene modifying polypeptide candidates having a Z-score of at least 1 or greater in any one of conditions 1, 2, 3, or 4.
SEQ ID NOs:

| | | | | | | | |
|---|---|---|---|---|---|---|---|
| 410 | 1029 | 1599 | 2052 | 2524 | 2951 | 6150 | 6734 | 7307 |
| 413 | 1030 | 1600 | 2053 | 2525 | 2952 | 6151 | 6736 | 7309 |
| 415 | 1031 | 1604 | 2054 | 2526 | 2953 | 6152 | 6738 | 7311 |
| 416 | 1032 | 1605 | 2055 | 2527 | 2954 | 6153 | 6739 | 7312 |
| 419 | 1033 | 1606 | 2056 | 2528 | 2955 | 6154 | 6740 | 7313 |
| 420 | 1034 | 1607 | 2057 | 2529 | 2957 | 6155 | 6741 | 7315 |
| 421 | 1035 | 1608 | 2058 | 2530 | 2958 | 6157 | 6743 | 7317 |
| 424 | 1036 | 1610 | 2059 | 2531 | 2959 | 6158 | 6744 | 7320 |
| 426 | 1037 | 1611 | 2060 | 2532 | 2960 | 6159 | 6745 | 7322 |
| 427 | 1038 | 1612 | 2061 | 2533 | 2962 | 6160 | 6746 | 7323 |
| 428 | 1039 | 1616 | 2062 | 2534 | 2965 | 6164 | 6747 | 7326 |
| 429 | 1040 | 1617 | 2063 | 2535 | 2966 | 6165 | 6750 | 7327 |
| 432 | 1041 | 1618 | 2064 | 2536 | 2967 | 6167 | 6751 | 7328 |
| 433 | 1042 | 1619 | 2066 | 2537 | 2968 | 6168 | 6752 | 7329 |
| 437 | 1043 | 1620 | 2069 | 2538 | 2969 | 6169 | 6754 | 7331 |
| 438 | 1044 | 1621 | 2070 | 2539 | 2971 | 6171 | 6756 | 7332 |
| 441 | 1045 | 1622 | 2071 | 2540 | 2972 | 6172 | 6757 | 7335 |
| 443 | 1046 | 1623 | 2072 | 2541 | 2973 | 6173 | 6758 | 7336 |
| 446 | 1047 | 1624 | 2074 | 2542 | 2974 | 6174 | 6760 | 7337 |
| 449 | 1048 | 1625 | 2075 | 2543 | 2975 | 6175 | 6761 | 7339 |
| 450 | 1049 | 1626 | 2076 | 2544 | 2976 | 6176 | 6762 | 7340 |
| 452 | 1050 | 1627 | 2079 | 2545 | 2978 | 6177 | 6764 | 7342 |
| 460 | 1051 | 1628 | 2080 | 2546 | 2979 | 6178 | 6765 | 7343 |
| 461 | 1052 | 1629 | 2081 | 2547 | 2981 | 6179 | 6771 | 7344 |
| 462 | 1053 | 1630 | 2082 | 2548 | 2982 | 6180 | 6772 | 7345 |
| 464 | 1054 | 1631 | 2084 | 2549 | 2983 | 6181 | 6773 | 7346 |
| 465 | 1055 | 1632 | 2085 | 2550 | 2984 | 6182 | 6774 | 7347 |
| 469 | 1056 | 1633 | 2086 | 2551 | 2985 | 6183 | 6775 | 7348 |
| 470 | 1057 | 1634 | 2089 | 2552 | 2986 | 6184 | 6776 | 7349 |
| 472 | 1058 | 1635 | 2090 | 2553 | 2987 | 6185 | 6777 | 7350 |
| 475 | 1059 | 1636 | 2091 | 2554 | 2988 | 6186 | 6778 | 7351 |
| 476 | 1060 | 1637 | 2092 | 2555 | 2989 | 6187 | 6779 | 7352 |
| 480 | 1061 | 1638 | 2093 | 2556 | 2990 | 6188 | 6780 | 7354 |
| 481 | 1062 | 1639 | 2094 | 2557 | 2991 | 6189 | 6781 | 7357 |
| 483 | 1063 | 1640 | 2095 | 2558 | 2992 | 6190 | 6782 | 7358 |
| 484 | 1064 | 1641 | 2096 | 2559 | 2993 | 6191 | 6783 | 7360 |

To characterize the reproducibility of the selected candidates without cell-type and test template confounders, two additional full experimental replicates were executed for the test template g4 condition in HEK293T cells (herein conditions 1b and 1c; original condition 1 hereafter became condition 1a) following the same experimental procedures detailed above. The analysis of the three condition 1 replicates identified a subset of approximately 260 gene modifying polypeptide candidates having a Z score of at least 1 or greater across all of replicates 1a, 1b, and 1c. These results show that this subset of gene modifying polypeptides had reproducible editing activity in all condition 1 replicates of the screening assay under this revised analysis. These include gene modifying polypeptides having amino acid sequences according to any one of the SEQ ID NOs listed in Table D7 below.

TABLE D7

Gene modifying polypeptide candidates having a Z-score of at least 1 or greater across all of replicates 1a, 1b, and 1c.
SEQ ID NOs

| | | | | | | |
|---|---|---|---|---|---|---|
| 156 | 1376 | 2320 | 2678 | 2927 | 4511 | 6760 |
| 300 | 1401 | 2324 | 2700 | 2929 | 4512 | 6761 |
| 317 | 1423 | 2327 | 2701 | 2930 | 4513 | 6783 |
| 346 | 1441 | 2329 | 2711 | 2933 | 4514 | 6788 |
| 352 | 1553 | 2331 | 2712 | 2937 | 4515 | 6876 |
| 591 | 1860 | 2332 | 2737 | 2953 | 4516 | 6883 |
| 647 | 1863 | 2333 | 2741 | 2957 | 4517 | 6998 |
| 801 | 1867 | 2338 | 2748 | 2972 | 4518 | 7067 |
| 871 | 1871 | 2343 | 2760 | 2983 | 4520 | 7103 |
| 898 | 1874 | 2345 | 2772 | 2995 | 4522 | 7121 |
| 933 | 1875 | 2359 | 2780 | 3007 | 4523 | 7142 |
| 1007 | 1876 | 2360 | 2781 | 3039 | 4524 | 7154 |
| 1008 | 1939 | 2370 | 2784 | 3044 | 4525 | 7242 |
| 1009 | 1943 | 2382 | 2786 | 3045 | 4526 | 7262 |
| 1011 | 1949 | 2400 | 2787 | 3057 | 4527 | 7267 |
| 1018 | 1951 | 2405 | 2788 | 3063 | 4528 | 7293 |
| 1021 | 1967 | 2510 | 2790 | 3065 | 4529 | 7335 |
| 1029 | 2060 | 2514 | 2791 | 3067 | 4530 | 7443 |
| 1033 | 2086 | 2527 | 2795 | 3076 | 4531 | 7476 |
| 1034 | 2092 | 2529 | 2797 | 3079 | 4533 | 7496 |
| 1037 | 2094 | 2535 | 2800 | 3083 | 4534 | 7509 |
| 1039 | 2104 | 2536 | 2810 | 3084 | 4535 | 7555 |
| 1044 | 2112 | 2539 | 2815 | 3085 | 4536 | 7587 |
| 1046 | 2114 | 2550 | 2820 | 3093 | 4537 | 7588 |
| 1047 | 2117 | 2553 | 2823 | 3096 | 4538 | 7660 |
| 1052 | 2132 | 2573 | 2825 | 3099 | 4539 | 7667 |
| 1056 | 2145 | 2583 | 2826 | 3103 | 4540 | |
| 1059 | 2148 | 2599 | 2830 | 3107 | 4541 | |
| 1060 | 2149 | 2610 | 2835 | 3111 | 6030 | |
| 1076 | 2161 | 2615 | 2836 | 3123 | 6073 | |
| 1083 | 2165 | 2620 | 2850 | 4501 | 6091 | |
| 1093 | 2172 | 2631 | 2880 | 4502 | 6181 | |
| 1197 | 2174 | 2634 | 2881 | 4503 | 6402 | |
| 1198 | 2196 | 2636 | 2888 | 4504 | 6434 | |
| 1219 | 2249 | 2644 | 2893 | 4506 | 6505 | |
| 1242 | 2280 | 2654 | 2903 | 4507 | 6567 | |
| 1262 | 2301 | 2656 | 2913 | 4508 | 6568 | |
| 1372 | 2311 | 2657 | 2914 | 4509 | 6591 | |
| 1373 | 2313 | 2660 | 2916 | 4510 | 6738 | |

Approximately 3070 gene modifying polypeptide candidates within the library had a Z-score of at least 1 or greater in any one of conditions 1a, 1b, or 1c using this further analysis. These results show that this subset of gene modifying polypeptides had editing activity in at least one replicate of condition 1 of the screening assay under this revised analysis. The subset of these gene modifying polypeptides are encoded by amino acid sequences of any one of the SEQ ID NOs listed in Table D8 below.

TABLE D8

Gene modifying polypeptide candidates having a Z-score of at least 1 or greater in any one of conditions 1a, 1b, or 1c.
SEQ ID NOs

| | | | | | | | | | |
|---|---|---|---|---|---|---|---|---|---|
| 1 | 731 | 1242 | 1882 | 2326 | 2690 | 3059 | 6301 | 6729 | 7174 | 7620 |
| 34 | 746 | 1243 | 1883 | 2327 | 2691 | 3060 | 6303 | 6730 | 7176 | 7621 |
| 35 | 765 | 1244 | 1884 | 2328 | 2692 | 3061 | 6304 | 6731 | 7178 | 7623 |
| 36 | 770 | 1245 | 1885 | 2329 | 2695 | 3062 | 6305 | 6732 | 7179 | 7625 |
| 37 | 772 | 1246 | 1886 | 2330 | 2697 | 3063 | 6307 | 6733 | 7180 | 7626 |
| 38 | 777 | 1247 | 1887 | 2331 | 2699 | 3064 | 6308 | 6734 | 7182 | 7627 |
| 39 | 780 | 1250 | 1889 | 2332 | 2700 | 3065 | 6310 | 6735 | 7183 | 7629 |
| 40 | 799 | 1253 | 1890 | 2333 | 2701 | 3066 | 6311 | 6737 | 7184 | 7630 |
| 45 | 800 | 1254 | 1891 | 2334 | 2702 | 3067 | 6312 | 6738 | 7185 | 7632 |
| 46 | 801 | 1255 | 1892 | 2335 | 2703 | 3068 | 6313 | 6742 | 7186 | 7633 |
| 47 | 802 | 1256 | 1893 | 2336 | 2711 | 3069 | 6314 | 6744 | 7187 | 7634 |
| 48 | 803 | 1257 | 1894 | 2337 | 2712 | 3070 | 6315 | 6746 | 7190 | 7635 |
| 49 | 804 | 1258 | 1896 | 2338 | 2713 | 3071 | 6316 | 6748 | 7191 | 7636 |
| 50 | 805 | 1259 | 1898 | 2339 | 2714 | 3072 | 6317 | 6749 | 7192 | 7637 |
| 51 | 806 | 1260 | 1899 | 2340 | 2715 | 3073 | 6320 | 6751 | 7194 | 7638 |
| 52 | 807 | 1261 | 1900 | 2341 | 2716 | 3074 | 6322 | 6752 | 7195 | 7639 |
| 55 | 808 | 1262 | 1901 | 2342 | 2717 | 3075 | 6324 | 6753 | 7196 | 7640 |
| 56 | 809 | 1263 | 1903 | 2343 | 2718 | 3076 | 6325 | 6754 | 7197 | 7641 |
| 57 | 811 | 1264 | 1905 | 2344 | 2719 | 3077 | 6327 | 6755 | 7198 | 7642 |
| 59 | 812 | 1265 | 1906 | 2345 | 2720 | 3078 | 6328 | 6758 | 7199 | 7643 |
| 61 | 813 | 1266 | 1907 | 2346 | 2721 | 3079 | 6329 | 6759 | 7200 | 7644 |
| 62 | 814 | 1267 | 1908 | 2347 | 2722 | 3080 | 6330 | 6760 | 7201 | 7646 |
| 63 | 817 | 1268 | 1909 | 2348 | 2723 | 3081 | 6332 | 6761 | 7202 | 7647 |
| 64 | 818 | 1269 | 1912 | 2349 | 2724 | 3082 | 6333 | 6763 | 7203 | 7648 |
| 65 | 819 | 1270 | 1913 | 2350 | 2726 | 3083 | 6336 | 6765 | 7204 | 7649 |
| 67 | 820 | 1272 | 1915 | 2351 | 2727 | 3084 | 6339 | 6766 | 7206 | 7650 |
| 68 | 821 | 1273 | 1916 | 2352 | 2728 | 3085 | 6340 | 6767 | 7209 | 7651 |
| 69 | 824 | 1274 | 1917 | 2353 | 2729 | 3086 | 6341 | 6768 | 7211 | 7653 |
| 70 | 825 | 1276 | 1918 | 2354 | 2730 | 3087 | 6342 | 6769 | 7212 | 7654 |
| 71 | 827 | 1278 | 1920 | 2355 | 2731 | 3088 | 6343 | 6772 | 7213 | 7655 |
| 72 | 828 | 1279 | 1921 | 2356 | 2732 | 3090 | 6344 | 6773 | 7216 | 7656 |
| 76 | 829 | 1281 | 1922 | 2357 | 2734 | 3091 | 6348 | 6774 | 7219 | 7658 |
| 78 | 830 | 1288 | 1923 | 2358 | 2736 | 3093 | 6349 | 6776 | 7222 | 7660 |
| 79 | 833 | 1298 | 1924 | 2359 | 2737 | 3094 | 6351 | 6777 | 7224 | 7661 |
| 81 | 834 | 1311 | 1925 | 2360 | 2739 | 3095 | 6352 | 6778 | 7225 | 7662 |
| 83 | 835 | 1319 | 1926 | 2361 | 2740 | 3096 | 6354 | 6780 | 7226 | 7664 |
| 85 | 836 | 1330 | 1927 | 2362 | 2741 | 3097 | 6355 | 6781 | 7227 | 7665 |
| 86 | 837 | 1343 | 1929 | 2363 | 2742 | 3098 | 6356 | 6782 | 7229 | 7666 |
| 88 | 839 | 1346 | 1932 | 2364 | 2743 | 3099 | 6357 | 6783 | 7230 | 7667 |
| 89 | 843 | 1348 | 1934 | 2365 | 2744 | 3100 | 6359 | 6784 | 7232 | 7670 |
| 90 | 844 | 1353 | 1935 | 2366 | 2745 | 3101 | 6360 | 6785 | 7234 | 7671 |
| 93 | 847 | 1354 | 1936 | 2367 | 2746 | 3102 | 6361 | 6786 | 7235 | 7672 |
| 94 | 848 | 1370 | 1937 | 2368 | 2747 | 3103 | 6362 | 6788 | 7240 | 7673 |
| 96 | 849 | 1371 | 1938 | 2369 | 2748 | 3104 | 6363 | 6789 | 7241 | 7675 |
| 97 | 850 | 1372 | 1939 | 2370 | 2750 | 3105 | 6364 | 6790 | 7242 | 7676 |
| 100 | 851 | 1373 | 1940 | 2371 | 2751 | 3106 | 6365 | 6793 | 7244 | 7678 |
| 103 | 852 | 1374 | 1941 | 2372 | 2753 | 3107 | 6366 | 6796 | 7245 | 7679 |
| 106 | 853 | 1375 | 1942 | 2373 | 2754 | 3108 | 6367 | 6797 | 7246 | 7680 |
| 108 | 854 | 1376 | 1943 | 2374 | 2755 | 3109 | 6368 | 6798 | 7248 | 7682 |
| 110 | 861 | 1377 | 1944 | 2375 | 2758 | 3110 | 6370 | 6801 | 7249 | 7683 |
| 111 | 862 | 1379 | 1945 | 2376 | 2760 | 3111 | 6371 | 6802 | 7250 | 7684 |
| 114 | 863 | 1380 | 1946 | 2377 | 2761 | 3112 | 6372 | 6803 | 7253 | 7687 |
| 115 | 866 | 1381 | 1947 | 2378 | 2764 | 3113 | 6373 | 6804 | 7254 | 7688 |
| 116 | 867 | 1383 | 1948 | 2379 | 2768 | 3114 | 6374 | 6808 | 7256 | 7689 |
| 117 | 870 | 1384 | 1949 | 2380 | 2769 | 3116 | 6375 | 6809 | 7257 | 7690 |
| 118 | 871 | 1385 | 1950 | 2381 | 2772 | 3117 | 6376 | 6810 | 7258 | 7691 |
| 119 | 872 | 1386 | 1951 | 2382 | 2773 | 3118 | 6377 | 6811 | 7259 | 7692 |
| 120 | 873 | 1387 | 1952 | 2383 | 2775 | 3119 | 6380 | 6812 | 7260 | 7693 |
| 121 | 874 | 1388 | 1953 | 2384 | 2776 | 3120 | 6381 | 6813 | 7261 | 7694 |
| 122 | 876 | 1389 | 1954 | 2385 | 2777 | 3121 | 6382 | 6815 | 7262 | 7695 |
| 123 | 877 | 1390 | 1955 | 2386 | 2780 | 3122 | 6383 | 6816 | 7263 | 7696 |
| 124 | 878 | 1391 | 1956 | 2387 | 2781 | 3123 | 6385 | 6817 | 7264 | 7697 |
| 125 | 879 | 1393 | 1957 | 2388 | 2782 | 3124 | 6386 | 6818 | 7266 | 7698 |
| 126 | 880 | 1394 | 1958 | 2389 | 2783 | 3125 | 6387 | 6819 | 7267 | 7699 |
| 127 | 881 | 1395 | 1959 | 2390 | 2784 | 3126 | 6388 | 6820 | 7268 | 7701 |
| 130 | 883 | 1396 | 1960 | 2391 | 2785 | 3127 | 6390 | 6821 | 7269 | 7702 |
| 131 | 884 | 1397 | 1961 | 2392 | 2786 | 3128 | 6391 | 6822 | 7271 | 7703 |
| 134 | 885 | 1398 | 1962 | 2393 | 2787 | 3129 | 6392 | 6825 | 7272 | 7704 |
| 137 | 886 | 1399 | 1964 | 2394 | 2788 | 3130 | 6394 | 6828 | 7273 | 7706 |

TABLE D8-continued

Gene modifying polypeptide candidates having a Z-score of at least 1 or greater in any one of conditions 1a, 1b, or 1c.
SEQ ID NOs

| | | | | | | | | | | |
|---|---|---|---|---|---|---|---|---|---|---|
| 138 | 887 | 1400 | 1965 | 2395 | 2789 | 3131 | 6395 | 6829 | 7274 | 7707 |
| 139 | 888 | 1401 | 1966 | 2396 | 2790 | 3133 | 6402 | 6831 | 7275 | 7709 |
| 143 | 890 | 1402 | 1967 | 2397 | 2791 | 3134 | 6405 | 6833 | 7276 | 7710 |
| 144 | 891 | 1403 | 1968 | 2398 | 2792 | 3135 | 6407 | 6835 | 7277 | 7711 |
| 145 | 892 | 1404 | 1969 | 2399 | 2793 | 3136 | 6408 | 6837 | 7279 | 7712 |
| 146 | 893 | 1405 | 1970 | 2400 | 2794 | 3194 | 6409 | 6839 | 7281 | 7716 |
| 147 | 894 | 1406 | 1972 | 2401 | 2795 | 3231 | 6410 | 6840 | 7282 | 7717 |
| 150 | 897 | 1408 | 1973 | 2402 | 2796 | 3317 | 6412 | 6844 | 7283 | 7719 |
| 153 | 898 | 1409 | 1974 | 2403 | 2797 | 4501 | 6413 | 6845 | 7284 | 7725 |
| 154 | 899 | 1410 | 1975 | 2404 | 2798 | 4502 | 6414 | 6846 | 7285 | 7728 |
| 156 | 900 | 1411 | 1976 | 2405 | 2799 | 4503 | 6416 | 6847 | 7286 | 7730 |
| 157 | 901 | 1412 | 1977 | 2406 | 2800 | 4504 | 6417 | 6850 | 7287 | 7736 |
| 158 | 902 | 1414 | 1978 | 2407 | 2801 | 4505 | 6419 | 6852 | 7291 | 7740 |
| 159 | 903 | 1415 | 1979 | 2408 | 2802 | 4506 | 6421 | 6855 | 7292 | 7742 |
| 160 | 905 | 1416 | 1980 | 2409 | 2803 | 4507 | 6422 | 6856 | 7293 | 7743 |
| 161 | 907 | 1417 | 1981 | 2410 | 2804 | 4508 | 6424 | 6858 | 7294 | |
| 162 | 908 | 1418 | 1982 | 2412 | 2805 | 4509 | 6425 | 6859 | 7295 | |
| 163 | 909 | 1419 | 1983 | 2413 | 2806 | 4510 | 6426 | 6861 | 7298 | |
| 164 | 910 | 1420 | 1984 | 2414 | 2807 | 4511 | 6428 | 6862 | 7299 | |
| 165 | 912 | 1422 | 1985 | 2415 | 2808 | 4512 | 6429 | 6863 | 7300 | |
| 167 | 914 | 1423 | 1986 | 2416 | 2809 | 4513 | 6430 | 6864 | 7301 | |
| 168 | 915 | 1424 | 1987 | 2440 | 2810 | 4514 | 6431 | 6866 | 7302 | |
| 170 | 916 | 1425 | 1988 | 2443 | 2811 | 4515 | 6432 | 6867 | 7303 | |
| 171 | 917 | 1426 | 1989 | 2444 | 2812 | 4516 | 6434 | 6868 | 7305 | |
| 172 | 918 | 1427 | 1990 | 2447 | 2813 | 4517 | 6436 | 6869 | 7306 | |
| 174 | 919 | 1428 | 1991 | 2448 | 2814 | 4518 | 6438 | 6870 | 7308 | |
| 176 | 920 | 1430 | 1992 | 2449 | 2815 | 4519 | 6439 | 6872 | 7309 | |
| 177 | 921 | 1433 | 1993 | 2451 | 2816 | 4520 | 6440 | 6874 | 7310 | |
| 180 | 922 | 1434 | 1994 | 2452 | 2817 | 4521 | 6441 | 6875 | 7311 | |
| 181 | 923 | 1437 | 1995 | 2453 | 2818 | 4522 | 6443 | 6876 | 7312 | |
| 182 | 924 | 1439 | 1996 | 2454 | 2820 | 4523 | 6444 | 6878 | 7313 | |
| 184 | 925 | 1440 | 1998 | 2455 | 2821 | 4524 | 6445 | 6883 | 7316 | |
| 190 | 928 | 1441 | 1999 | 2456 | 2822 | 4525 | 6447 | 6885 | 7317 | |
| 191 | 929 | 1442 | 2000 | 2457 | 2823 | 4526 | 6450 | 6886 | 7318 | |
| 192 | 933 | 1443 | 2002 | 2458 | 2824 | 4527 | 6452 | 6888 | 7319 | |
| 195 | 934 | 1444 | 2003 | 2459 | 2825 | 4528 | 6455 | 6889 | 7320 | |
| 196 | 935 | 1445 | 2004 | 2460 | 2826 | 4529 | 6458 | 6890 | 7321 | |
| 199 | 936 | 1446 | 2006 | 2461 | 2827 | 4530 | 6464 | 6891 | 7322 | |
| 200 | 938 | 1447 | 2009 | 2462 | 2828 | 4531 | 6465 | 6892 | 7323 | |
| 203 | 940 | 1448 | 2010 | 2465 | 2829 | 4532 | 6466 | 6896 | 7324 | |
| 204 | 942 | 1454 | 2011 | 2466 | 2830 | 4533 | 6467 | 6897 | 7325 | |
| 206 | 943 | 1460 | 2012 | 2467 | 2831 | 4534 | 6468 | 6898 | 7326 | |
| 208 | 944 | 1465 | 2013 | 2469 | 2832 | 4535 | 6469 | 6902 | 7329 | |
| 209 | 946 | 1469 | 2014 | 2470 | 2833 | 4536 | 6470 | 6906 | 7330 | |
| 210 | 947 | 1475 | 2016 | 2471 | 2834 | 4537 | 6471 | 6908 | 7333 | |
| 213 | 948 | 1504 | 2017 | 2480 | 2835 | 4538 | 6472 | 6909 | 7334 | |
| 215 | 951 | 1542 | 2018 | 2481 | 2836 | 4539 | 6476 | 6910 | 7335 | |
| 216 | 959 | 1543 | 2020 | 2483 | 2837 | 4540 | 6477 | 6911 | 7336 | |
| 217 | 960 | 1544 | 2023 | 2485 | 2838 | 4541 | 6478 | 6912 | 7338 | |
| 218 | 961 | 1546 | 2024 | 2486 | 2839 | 6001 | 6479 | 6914 | 7339 | |
| 219 | 962 | 1547 | 2025 | 2488 | 2840 | 6002 | 6480 | 6915 | 7341 | |
| 220 | 963 | 1549 | 2027 | 2489 | 2841 | 6003 | 6481 | 6916 | 7342 | |
| 222 | 964 | 1550 | 2028 | 2496 | 2842 | 6005 | 6482 | 6919 | 7343 | |
| 223 | 965 | 1552 | 2029 | 2502 | 2843 | 6008 | 6483 | 6920 | 7345 | |
| 224 | 966 | 1553 | 2030 | 2503 | 2844 | 6009 | 6485 | 6922 | 7346 | |
| 225 | 967 | 1556 | 2031 | 2504 | 2845 | 6010 | 6486 | 6923 | 7348 | |
| 226 | 968 | 1565 | 2033 | 2505 | 2846 | 6012 | 6487 | 6924 | 7349 | |
| 227 | 969 | 1566 | 2034 | 2506 | 2847 | 6013 | 6488 | 6925 | 7351 | |
| 229 | 970 | 1567 | 2035 | 2507 | 2848 | 6014 | 6489 | 6926 | 7352 | |
| 231 | 971 | 1568 | 2036 | 2508 | 2849 | 6016 | 6491 | 6927 | 7353 | |
| 232 | 972 | 1570 | 2037 | 2509 | 2850 | 6020 | 6493 | 6928 | 7355 | |
| 234 | 975 | 1573 | 2041 | 2510 | 2851 | 6022 | 6494 | 6930 | 7356 | |
| 236 | 976 | 1576 | 2043 | 2511 | 2852 | 6027 | 6498 | 6931 | 7357 | |
| 237 | 977 | 1577 | 2045 | 2512 | 2853 | 6028 | 6499 | 6933 | 7358 | |
| 238 | 978 | 1579 | 2047 | 2513 | 2854 | 6029 | 6500 | 6935 | 7359 | |
| 239 | 979 | 1580 | 2048 | 2514 | 2856 | 6030 | 6501 | 6936 | 7360 | |
| 240 | 980 | 1584 | 2050 | 2515 | 2857 | 6032 | 6502 | 6937 | 7363 | |
| 241 | 981 | 1585 | 2051 | 2516 | 2858 | 6034 | 6503 | 6938 | 7364 | |
| 248 | 982 | 1588 | 2052 | 2517 | 2859 | 6036 | 6504 | 6939 | 7365 | |
| 252 | 983 | 1590 | 2055 | 2518 | 2860 | 6037 | 6505 | 6940 | 7366 | |
| 253 | 985 | 1593 | 2060 | 2519 | 2861 | 6038 | 6508 | 6941 | 7367 | |
| 254 | 986 | 1595 | 2071 | 2520 | 2862 | 6039 | 6509 | 6942 | 7368 | |
| 255 | 987 | 1596 | 2072 | 2521 | 2863 | 6041 | 6511 | 6943 | 7369 | |
| 257 | 988 | 1599 | 2084 | 2522 | 2864 | 6042 | 6512 | 6945 | 7370 | |
| 258 | 989 | 1616 | 2086 | 2523 | 2865 | 6043 | 6513 | 6946 | 7371 | |
| 259 | 990 | 1617 | 2087 | 2524 | 2866 | 6044 | 6514 | 6948 | 7372 | |

TABLE D8-continued

Gene modifying polypeptide candidates having a Z-score of at least 1 or greater in any one of conditions 1a, 1b, or 1c.
SEQ ID NOs

| | | | | | | | | |
|---|---|---|---|---|---|---|---|---|
| 260 | 993 | 1618 | 2088 | 2525 | 2867 | 6045 | 6515 | 6949 | 7373 |
| 261 | 994 | 1619 | 2089 | 2526 | 2868 | 6047 | 6516 | 6952 | 7376 |
| 262 | 995 | 1620 | 2091 | 2527 | 2869 | 6048 | 6517 | 6954 | 7378 |
| 265 | 996 | 1621 | 2092 | 2528 | 2870 | 6049 | 6518 | 6955 | 7381 |
| 266 | 998 | 1622 | 2093 | 2529 | 2871 | 6052 | 6519 | 6956 | 7384 |
| 267 | 999 | 1625 | 2094 | 2530 | 2872 | 6053 | 6521 | 6957 | 7385 |
| 268 | 1001 | 1628 | 2096 | 2531 | 2873 | 6054 | 6522 | 6958 | 7387 |
| 269 | 1002 | 1629 | 2100 | 2532 | 2874 | 6057 | 6523 | 6959 | 7389 |
| 270 | 1003 | 1632 | 2101 | 2533 | 2875 | 6059 | 6524 | 6960 | 7393 |
| 271 | 1005 | 1633 | 2102 | 2534 | 2877 | 6062 | 6525 | 6961 | 7394 |
| 272 | 1006 | 1634 | 2103 | 2535 | 2878 | 6063 | 6526 | 6963 | 7395 |
| 273 | 1007 | 1635 | 2104 | 2536 | 2880 | 6065 | 6527 | 6964 | 7397 |
| 283 | 1008 | 1636 | 2107 | 2537 | 2881 | 6067 | 6528 | 6966 | 7399 |
| 284 | 1009 | 1638 | 2108 | 2538 | 2882 | 6070 | 6530 | 6967 | 7400 |
| 286 | 1010 | 1639 | 2109 | 2539 | 2883 | 6071 | 6531 | 6968 | 7401 |
| 287 | 1011 | 1640 | 2111 | 2540 | 2884 | 6073 | 6532 | 6969 | 7402 |
| 288 | 1012 | 1644 | 2112 | 2541 | 2885 | 6074 | 6534 | 6973 | 7403 |
| 292 | 1014 | 1646 | 2114 | 2542 | 2886 | 6077 | 6536 | 6975 | 7405 |
| 295 | 1015 | 1652 | 2115 | 2543 | 2887 | 6078 | 6537 | 6977 | 7407 |
| 297 | 1016 | 1655 | 2116 | 2544 | 2888 | 6079 | 6539 | 6979 | 7408 |
| 298 | 1017 | 1659 | 2117 | 2545 | 2890 | 6082 | 6540 | 6980 | 7410 |
| 300 | 1018 | 1660 | 2121 | 2546 | 2891 | 6083 | 6542 | 6981 | 7411 |
| 301 | 1019 | 1662 | 2124 | 2547 | 2893 | 6084 | 6543 | 6982 | 7412 |
| 302 | 1020 | 1663 | 2125 | 2548 | 2894 | 6086 | 6546 | 6983 | 7416 |
| 304 | 1021 | 1664 | 2126 | 2549 | 2895 | 6087 | 6549 | 6985 | 7417 |
| 305 | 1022 | 1665 | 2128 | 2550 | 2896 | 6091 | 6550 | 6986 | 7418 |
| 306 | 1023 | 1666 | 2131 | 2551 | 2897 | 6093 | 6551 | 6987 | 7421 |
| 307 | 1024 | 1667 | 2132 | 2552 | 2898 | 6095 | 6552 | 6988 | 7422 |
| 309 | 1025 | 1669 | 2133 | 2553 | 2899 | 6097 | 6553 | 6989 | 7423 |
| 310 | 1027 | 1670 | 2135 | 2554 | 2900 | 6098 | 6555 | 6990 | 7424 |
| 312 | 1028 | 1671 | 2136 | 2555 | 2901 | 6100 | 6556 | 6991 | 7425 |
| 313 | 1029 | 1672 | 2137 | 2556 | 2903 | 6104 | 6558 | 6992 | 7429 |
| 314 | 1030 | 1673 | 2142 | 2557 | 2904 | 6105 | 6559 | 6993 | 7430 |
| 315 | 1031 | 1675 | 2143 | 2558 | 2905 | 6106 | 6560 | 6994 | 7433 |
| 317 | 1032 | 1679 | 2144 | 2559 | 2906 | 6108 | 6561 | 6995 | 7435 |
| 318 | 1033 | 1680 | 2145 | 2560 | 2907 | 6111 | 6562 | 6997 | 7436 |
| 319 | 1034 | 1681 | 2146 | 2561 | 2908 | 6113 | 6564 | 6998 | 7437 |
| 320 | 1035 | 1682 | 2147 | 2562 | 2909 | 6114 | 6566 | 7000 | 7439 |
| 321 | 1037 | 1686 | 2148 | 2563 | 2911 | 6115 | 6567 | 7003 | 7440 |
| 322 | 1038 | 1687 | 2149 | 2564 | 2912 | 6117 | 6568 | 7005 | 7443 |
| 323 | 1039 | 1688 | 2153 | 2565 | 2913 | 6118 | 6570 | 7008 | 7444 |
| 324 | 1040 | 1689 | 2157 | 2566 | 2914 | 6119 | 6571 | 7009 | 7447 |
| 326 | 1041 | 1690 | 2158 | 2567 | 2916 | 6120 | 6572 | 7010 | 7453 |
| 328 | 1042 | 1691 | 2159 | 2568 | 2917 | 6121 | 6574 | 7011 | 7454 |
| 329 | 1043 | 1694 | 2160 | 2569 | 2918 | 6123 | 6575 | 7012 | 7456 |
| 330 | 1044 | 1695 | 2161 | 2570 | 2919 | 6126 | 6576 | 7013 | 7459 |
| 331 | 1045 | 1698 | 2165 | 2571 | 2920 | 6127 | 6578 | 7014 | 7460 |
| 332 | 1046 | 1699 | 2166 | 2572 | 2921 | 6128 | 6579 | 7015 | 7462 |
| 334 | 1047 | 1700 | 2167 | 2573 | 2922 | 6129 | 6581 | 7017 | 7463 |
| 335 | 1049 | 1701 | 2168 | 2574 | 2924 | 6130 | 6582 | 7018 | 7465 |
| 336 | 1050 | 1702 | 2169 | 2575 | 2925 | 6132 | 6584 | 7019 | 7468 |
| 337 | 1051 | 1704 | 2171 | 2576 | 2926 | 6133 | 6585 | 7022 | 7469 |
| 339 | 1052 | 1705 | 2172 | 2577 | 2927 | 6134 | 6587 | 7023 | 7470 |
| 343 | 1053 | 1706 | 2174 | 2578 | 2928 | 6135 | 6588 | 7024 | 7473 |
| 344 | 1054 | 1707 | 2175 | 2579 | 2929 | 6141 | 6591 | 7029 | 7474 |
| 345 | 1055 | 1708 | 2176 | 2580 | 2930 | 6142 | 6592 | 7031 | 7476 |
| 346 | 1056 | 1709 | 2177 | 2582 | 2931 | 6143 | 6594 | 7032 | 7477 |
| 347 | 1057 | 1711 | 2178 | 2583 | 2932 | 6144 | 6595 | 7033 | 7478 |
| 348 | 1058 | 1713 | 2179 | 2584 | 2933 | 6145 | 6599 | 7036 | 7480 |
| 350 | 1059 | 1714 | 2180 | 2585 | 2935 | 6146 | 6601 | 7038 | 7481 |
| 351 | 1060 | 1716 | 2187 | 2586 | 2936 | 6147 | 6603 | 7039 | 7482 |
| 352 | 1061 | 1717 | 2189 | 2587 | 2937 | 6148 | 6604 | 7041 | 7485 |
| 354 | 1062 | 1719 | 2192 | 2588 | 2938 | 6149 | 6607 | 7042 | 7486 |
| 355 | 1063 | 1720 | 2193 | 2589 | 2940 | 6150 | 6609 | 7044 | 7487 |
| 356 | 1064 | 1721 | 2194 | 2590 | 2942 | 6151 | 6610 | 7045 | 7488 |
| 357 | 1065 | 1722 | 2196 | 2591 | 2943 | 6152 | 6613 | 7046 | 7490 |
| 360 | 1066 | 1724 | 2199 | 2592 | 2944 | 6155 | 6615 | 7047 | 7493 |
| 361 | 1068 | 1726 | 2201 | 2593 | 2945 | 6156 | 6617 | 7050 | 7496 |
| 362 | 1069 | 1727 | 2204 | 2594 | 2948 | 6161 | 6618 | 7051 | 7497 |
| 363 | 1070 | 1733 | 2208 | 2595 | 2949 | 6162 | 6619 | 7054 | 7498 |
| 364 | 1071 | 1734 | 2209 | 2596 | 2950 | 6166 | 6620 | 7055 | 7499 |
| 366 | 1072 | 1735 | 2213 | 2598 | 2951 | 6169 | 6621 | 7057 | 7500 |
| 368 | 1074 | 1736 | 2214 | 2599 | 2952 | 6170 | 6622 | 7058 | 7504 |
| 369 | 1075 | 1737 | 2215 | 2600 | 2953 | 6171 | 6623 | 7059 | 7506 |
| 370 | 1076 | 1738 | 2220 | 2601 | 2954 | 6175 | 6624 | 7060 | 7507 |
| 372 | 1077 | 1740 | 2222 | 2602 | 2955 | 6176 | 6625 | 7061 | 7508 |

TABLE D8-continued

Gene modifying polypeptide candidates having a Z-score of at least 1 or greater in any one of conditions 1a, 1b, or 1c.
SEQ ID NOs

| | | | | | | | | | |
|---|---|---|---|---|---|---|---|---|---|
| 374 | 1078 | 1741 | 2223 | 2603 | 2957 | 6177 | 6626 | 7062 | 7509 |
| 375 | 1079 | 1742 | 2224 | 2605 | 2965 | 6180 | 6627 | 7064 | 7510 |
| 376 | 1080 | 1743 | 2225 | 2606 | 2966 | 6181 | 6630 | 7065 | 7513 |
| 377 | 1081 | 1744 | 2226 | 2607 | 2967 | 6182 | 6631 | 7066 | 7516 |
| 382 | 1082 | 1746 | 2227 | 2608 | 2969 | 6183 | 6632 | 7067 | 7519 |
| 384 | 1083 | 1747 | 2228 | 2610 | 2970 | 6189 | 6633 | 7068 | 7520 |
| 386 | 1084 | 1748 | 2230 | 2611 | 2971 | 6190 | 6634 | 7069 | 7522 |
| 388 | 1085 | 1751 | 2231 | 2612 | 2972 | 6194 | 6636 | 7070 | 7523 |
| 389 | 1086 | 1752 | 2232 | 2614 | 2973 | 6196 | 6638 | 7072 | 7524 |
| 390 | 1088 | 1754 | 2233 | 2615 | 2974 | 6198 | 6639 | 7073 | 7525 |
| 391 | 1089 | 1756 | 2235 | 2616 | 2975 | 6199 | 6640 | 7075 | 7526 |
| 392 | 1091 | 1759 | 2236 | 2617 | 2976 | 6200 | 6641 | 7076 | 7530 |
| 393 | 1092 | 1764 | 2237 | 2618 | 2977 | 6202 | 6642 | 7079 | 7531 |
| 394 | 1093 | 1765 | 2239 | 2619 | 2978 | 6203 | 6643 | 7080 | 7532 |
| 395 | 1096 | 1767 | 2241 | 2620 | 2981 | 6205 | 6644 | 7082 | 7533 |
| 397 | 1115 | 1768 | 2243 | 2621 | 2982 | 6206 | 6645 | 7084 | 7535 |
| 398 | 1116 | 1769 | 2244 | 2622 | 2983 | 6208 | 6646 | 7085 | 7536 |
| 399 | 1118 | 1770 | 2245 | 2623 | 2984 | 6209 | 6647 | 7086 | 7537 |
| 403 | 1127 | 1771 | 2246 | 2624 | 2985 | 6211 | 6648 | 7087 | 7538 |
| 404 | 1129 | 1772 | 2247 | 2625 | 2987 | 6213 | 6649 | 7088 | 7541 |
| 405 | 1137 | 1773 | 2248 | 2626 | 2989 | 6216 | 6650 | 7089 | 7544 |
| 406 | 1138 | 1774 | 2249 | 2627 | 2990 | 6219 | 6651 | 7091 | 7545 |
| 407 | 1143 | 1777 | 2250 | 2628 | 2991 | 6220 | 6652 | 7092 | 7546 |
| 413 | 1145 | 1778 | 2252 | 2629 | 2992 | 6221 | 6653 | 7093 | 7547 |
| 460 | 1150 | 1780 | 2253 | 2630 | 2994 | 6224 | 6654 | 7094 | 7548 |
| 474 | 1154 | 1781 | 2255 | 2631 | 2995 | 6225 | 6657 | 7095 | 7550 |
| 480 | 1155 | 1782 | 2256 | 2632 | 2996 | 6228 | 6658 | 7096 | 7551 |
| 489 | 1156 | 1785 | 2257 | 2633 | 2997 | 6229 | 6659 | 7100 | 7552 |
| 498 | 1157 | 1786 | 2260 | 2634 | 2998 | 6230 | 6660 | 7101 | 7553 |
| 517 | 1159 | 1789 | 2261 | 2635 | 2999 | 6231 | 6662 | 7102 | 7554 |
| 519 | 1161 | 1790 | 2262 | 2636 | 3002 | 6232 | 6663 | 7103 | 7555 |
| 524 | 1163 | 1791 | 2263 | 2637 | 3005 | 6233 | 6664 | 7104 | 7556 |
| 528 | 1164 | 1793 | 2265 | 2638 | 3006 | 6234 | 6666 | 7105 | 7557 |
| 534 | 1168 | 1794 | 2266 | 2639 | 3007 | 6235 | 6667 | 7106 | 7558 |
| 536 | 1169 | 1796 | 2270 | 2640 | 3008 | 6237 | 6670 | 7107 | 7559 |
| 541 | 1170 | 1799 | 2271 | 2641 | 3009 | 6238 | 6673 | 7108 | 7560 |
| 550 | 1171 | 1800 | 2272 | 2642 | 3010 | 6242 | 6674 | 7110 | 7562 |
| 555 | 1172 | 1801 | 2273 | 2643 | 3011 | 6246 | 6675 | 7111 | 7567 |
| 556 | 1176 | 1802 | 2275 | 2644 | 3012 | 6247 | 6676 | 7113 | 7569 |
| 564 | 1193 | 1804 | 2276 | 2645 | 3013 | 6248 | 6677 | 7117 | 7570 |
| 568 | 1195 | 1805 | 2278 | 2646 | 3014 | 6251 | 6678 | 7120 | 7571 |
| 569 | 1196 | 1810 | 2280 | 2647 | 3015 | 6252 | 6679 | 7121 | 7572 |
| 571 | 1197 | 1811 | 2281 | 2648 | 3018 | 6253 | 6682 | 7122 | 7573 |
| 580 | 1198 | 1812 | 2282 | 2649 | 3019 | 6256 | 6683 | 7124 | 7574 |
| 581 | 1199 | 1813 | 2283 | 2650 | 3020 | 6257 | 6684 | 7126 | 7575 |
| 586 | 1200 | 1816 | 2286 | 2651 | 3021 | 6258 | 6685 | 7127 | 7576 |
| 587 | 1201 | 1823 | 2287 | 2652 | 3022 | 6259 | 6686 | 7129 | 7577 |
| 588 | 1202 | 1824 | 2289 | 2653 | 3024 | 6260 | 6687 | 7130 | 7578 |
| 590 | 1203 | 1827 | 2291 | 2654 | 3025 | 6262 | 6688 | 7131 | 7582 |
| 591 | 1204 | 1829 | 2294 | 2655 | 3026 | 6263 | 6690 | 7132 | 7583 |
| 592 | 1205 | 1831 | 2295 | 2656 | 3027 | 6265 | 6691 | 7134 | 7584 |
| 593 | 1206 | 1835 | 2299 | 2657 | 3028 | 6267 | 6692 | 7135 | 7585 |
| 594 | 1207 | 1854 | 2300 | 2658 | 3030 | 6268 | 6695 | 7137 | 7586 |
| 595 | 1208 | 1855 | 2301 | 2659 | 3031 | 6269 | 6696 | 7139 | 7587 |
| 599 | 1209 | 1856 | 2302 | 2660 | 3035 | 6270 | 6697 | 7141 | 7588 |
| 602 | 1210 | 1857 | 2303 | 2661 | 3036 | 6271 | 6698 | 7142 | 7590 |
| 603 | 1212 | 1858 | 2304 | 2662 | 3037 | 6272 | 6699 | 7144 | 7592 |
| 611 | 1213 | 1859 | 2305 | 2663 | 3038 | 6273 | 6700 | 7145 | 7594 |
| 613 | 1214 | 1860 | 2306 | 2664 | 3039 | 6274 | 6701 | 7146 | 7596 |
| 616 | 1215 | 1861 | 2307 | 2665 | 3040 | 6275 | 6702 | 7147 | 7597 |
| 628 | 1216 | 1862 | 2308 | 2666 | 3041 | 6276 | 6704 | 7148 | 7598 |
| 638 | 1217 | 1863 | 2309 | 2667 | 3042 | 6278 | 6706 | 7149 | 7599 |
| 645 | 1218 | 1864 | 2310 | 2670 | 3043 | 6279 | 6707 | 7150 | 7600 |
| 647 | 1219 | 1865 | 2311 | 2672 | 3044 | 6280 | 6708 | 7151 | 7601 |
| 648 | 1220 | 1866 | 2312 | 2673 | 3045 | 6282 | 6709 | 7152 | 7602 |
| 649 | 1222 | 1867 | 2313 | 2674 | 3046 | 6283 | 6711 | 7153 | 7603 |
| 651 | 1223 | 1868 | 2314 | 2675 | 3047 | 6284 | 6712 | 7154 | 7604 |
| 654 | 1224 | 1869 | 2315 | 2676 | 3048 | 6285 | 6714 | 7155 | 7605 |
| 659 | 1225 | 1870 | 2316 | 2677 | 3049 | 6286 | 6715 | 7156 | 7606 |
| 660 | 1227 | 1871 | 2317 | 2678 | 3050 | 6287 | 6716 | 7158 | 7608 |
| 662 | 1228 | 1872 | 2318 | 2679 | 3051 | 6288 | 6717 | 7159 | 7609 |
| 674 | 1230 | 1874 | 2319 | 2681 | 3052 | 6290 | 6719 | 7160 | 7610 |
| 675 | 1232 | 1875 | 2320 | 2684 | 3053 | 6291 | 6720 | 7164 | 7611 |
| 676 | 1233 | 1876 | 2321 | 2685 | 3054 | 6293 | 6721 | 7165 | 7614 |
| 677 | 1235 | 1877 | 2322 | 2686 | 3055 | 6294 | 6725 | 7169 | 7615 |
| 681 | 1237 | 1878 | 2323 | 2687 | 3056 | 6296 | 6726 | 7171 | 7616 |

TABLE D8-continued

Gene modifying polypeptide candidates having a Z-score of at least 1 or greater in any one of conditions 1a, 1b, or 1c.
SEQ ID NOs

| | | | | | | | | | |
|---|---|---|---|---|---|---|---|---|---|
| 704 | 1238 | 1880 | 2324 | 2688 | 3057 | 6297 | 6727 | 7172 | 7618 |
| 722 | 1239 | 1881 | 2325 | 2689 | 3058 | 6299 | 6728 | 7173 | 7619 |

Taken together, the various analyses identified approximately 625 gene modifying polypeptides within the library that had a Z-score of at least 1 or greater in 3 or more conditions or replicates tested, and approximately 4625 gene modifying polypeptides within the library that had a Z-score of at least 1 or greater in at least one condition (these include gene modifying polypeptides having amino amino acid sequences according to any one of the SEQ ID NOs listed in Tables D9 and D10, respectively).

TABLE D9

Gene modifying polypeptide candidates having a Z-score of at least 1 or greater in 3 or more conditions or replicates tested.
SEQ ID NOs

| | | | | | | | | |
|---|---|---|---|---|---|---|---|---|
| 34 | 883 | 1376 | 1942 | 2332 | 2619 | 2817 | 3076 | 6567 |
| 35 | 884 | 1377 | 1943 | 2333 | 2620 | 2818 | 3079 | 6568 |
| 36 | 890 | 1380 | 1945 | 2335 | 2622 | 2820 | 3083 | 6591 |
| 37 | 898 | 1381 | 1949 | 2338 | 2623 | 2822 | 3084 | 6738 |
| 38 | 900 | 1382 | 1951 | 2342 | 2624 | 2823 | 3085 | 6760 |
| 39 | 901 | 1383 | 1953 | 2343 | 2627 | 2825 | 3087 | 6761 |
| 40 | 912 | 1384 | 1961 | 2345 | 2629 | 2826 | 3091 | 6783 |
| 41 | 915 | 1385 | 1967 | 2346 | 2631 | 2830 | 3093 | 6788 |
| 48 | 929 | 1389 | 1968 | 2347 | 2632 | 2833 | 3094 | 6876 |
| 49 | 933 | 1390 | 1970 | 2353 | 2633 | 2835 | 3096 | 6883 |
| 62 | 958 | 1394 | 1976 | 2359 | 2634 | 2836 | 3099 | 6925 |
| 97 | 960 | 1397 | 1978 | 2360 | 2636 | 2838 | 3103 | 6998 |
| 113 | 961 | 1399 | 1991 | 2363 | 2638 | 2840 | 3107 | 7036 |
| 117 | 963 | 1400 | 1992 | 2364 | 2639 | 2850 | 3108 | 7067 |
| 121 | 964 | 1401 | 2048 | 2365 | 2644 | 2865 | 3111 | 7103 |
| 123 | 966 | 1402 | 2060 | 2370 | 2647 | 2871 | 3112 | 7121 |
| 139 | 967 | 1404 | 2086 | 2371 | 2648 | 2874 | 3116 | 7142 |
| 140 | 978 | 1405 | 2091 | 2382 | 2649 | 2877 | 3120 | 7154 |
| 141 | 987 | 1406 | 2092 | 2395 | 2653 | 2878 | 3121 | 7242 |
| 142 | 1006 | 1410 | 2093 | 2400 | 2654 | 2880 | 3123 | 7262 |
| 144 | 1007 | 1415 | 2094 | 2403 | 2656 | 2881 | 3124 | 7267 |
| 147 | 1008 | 1419 | 2104 | 2405 | 2657 | 2886 | 3125 | 7293 |
| 156 | 1009 | 1422 | 2112 | 2449 | 2660 | 2887 | 3126 | 7335 |
| 190 | 1011 | 1423 | 2114 | 2503 | 2666 | 2888 | 3130 | 7397 |
| 191 | 1012 | 1424 | 2115 | 2504 | 2667 | 2890 | 3136 | 7443 |
| 192 | 1015 | 1441 | 2117 | 2505 | 2675 | 2893 | 4501 | 7476 |
| 195 | 1016 | 1540 | 2132 | 2506 | 2676 | 2895 | 4502 | 7496 |
| 199 | 1017 | 1543 | 2137 | 2507 | 2678 | 2901 | 4503 | 7509 |
| 212 | 1018 | 1550 | 2144 | 2508 | 2681 | 2903 | 4504 | 7555 |
| 213 | 1019 | 1553 | 2145 | 2510 | 2700 | 2904 | 4505 | 7587 |
| 219 | 1020 | 1616 | 2148 | 2511 | 2701 | 2905 | 4506 | 7588 |
| 228 | 1021 | 1618 | 2149 | 2512 | 2711 | 2909 | 4507 | 7660 |
| 232 | 1022 | 1619 | 2158 | 2513 | 2712 | 2913 | 4508 | 7667 |
| 239 | 1023 | 1666 | 2161 | 2514 | 2713 | 2914 | 4509 | |
| 252 | 1025 | 1668 | 2165 | 2515 | 2714 | 2916 | 4510 | |
| 258 | 1029 | 1672 | 2172 | 2518 | 2715 | 2920 | 4511 | |
| 268 | 1033 | 1677 | 2174 | 2519 | 2716 | 2922 | 4512 | |
| 300 | 1034 | 1679 | 2192 | 2521 | 2718 | 2927 | 4513 | |
| 303 | 1037 | 1682 | 2196 | 2525 | 2721 | 2928 | 4514 | |
| 313 | 1038 | 1686 | 2225 | 2526 | 2723 | 2929 | 4515 | |
| 316 | 1039 | 1690 | 2226 | 2527 | 2726 | 2930 | 4516 | |
| 317 | 1043 | 1691 | 2227 | 2528 | 2731 | 2932 | 4517 | |
| 318 | 1044 | 1695 | 2231 | 2529 | 2734 | 2933 | 4518 | |
| 320 | 1046 | 1698 | 2235 | 2530 | 2737 | 2937 | 4519 | |
| 332 | 1047 | 1721 | 2236 | 2531 | 2741 | 2943 | 4520 | |
| 341 | 1049 | 1754 | 2249 | 2534 | 2744 | 2948 | 4521 | |
| 346 | 1052 | 1759 | 2280 | 2535 | 2745 | 2950 | 4522 | |
| 352 | 1056 | 1769 | 2299 | 2536 | 2748 | 2953 | 4523 | |
| 363 | 1059 | 1770 | 2300 | 2539 | 2760 | 2957 | 4524 | |
| 384 | 1060 | 1772 | 2301 | 2542 | 2772 | 2966 | 4525 | |
| 386 | 1061 | 1773 | 2302 | 2544 | 2780 | 2967 | 4526 | |
| 392 | 1076 | 1856 | 2303 | 2547 | 2781 | 2972 | 4527 | |
| 396 | 1083 | 1857 | 2304 | 2548 | 2782 | 2976 | 4528 | |
| 480 | 1093 | 1860 | 2305 | 2550 | 2783 | 2982 | 4529 | |
| 550 | 1115 | 1861 | 2308 | 2551 | 2784 | 2983 | 4530 | |
| 590 | 1137 | 1863 | 2309 | 2553 | 2786 | 2991 | 4531 | |
| 591 | 1168 | 1864 | 2311 | 2556 | 2787 | 2995 | 4532 | |
| 647 | 1171 | 1865 | 2312 | 2559 | 2788 | 3007 | 4533 | |

TABLE D9-continued

Gene modifying polypeptide candidates having a Z-score of at least 1 or greater in 3 or more conditions or replicates tested.
SEQ ID NOs

| | | | | | | | |
|---|---|---|---|---|---|---|---|
| 715 | 1197 | 1867 | 2313 | 2561 | 2789 | 3014 | 4534 |
| 800 | 1198 | 1868 | 2314 | 2562 | 2790 | 3015 | 4535 |
| 801 | 1202 | 1870 | 2315 | 2566 | 2791 | 3018 | 4536 |
| 804 | 1203 | 1871 | 2316 | 2568 | 2792 | 3026 | 4537 |
| 805 | 1210 | 1874 | 2317 | 2573 | 2794 | 3035 | 4538 |
| 806 | 1216 | 1875 | 2319 | 2578 | 2795 | 3039 | 4539 |
| 818 | 1219 | 1876 | 2320 | 2583 | 2797 | 3042 | 4540 |
| 819 | 1225 | 1877 | 2322 | 2585 | 2798 | 3044 | 4541 |
| 871 | 1235 | 1881 | 2323 | 2592 | 2800 | 3045 | 6030 |
| 872 | 1242 | 1883 | 2324 | 2599 | 2801 | 3052 | 6073 |
| 873 | 1262 | 1889 | 2325 | 2610 | 2802 | 3053 | 6091 |
| 874 | 1371 | 1899 | 2326 | 2611 | 2804 | 3057 | 6181 |
| 876 | 1372 | 1937 | 2327 | 2612 | 2808 | 3059 | 6312 |
| 878 | 1373 | 1938 | 2328 | 2614 | 2810 | 3063 | 6402 |
| 880 | 1374 | 1939 | 2329 | 2615 | 2813 | 3065 | 6434 |
| 882 | 1375 | 1940 | 2331 | 2618 | 2815 | 3067 | 6505 |

TABLE D10

Gene modifying polypeptide candidates having a Z-score of at least 1 or greater in at least one condition.
SEQ ID NOs:

| | | | | | | | | |
|---|---|---|---|---|---|---|---|---|
| 1 | 596 | 1217 | 1846 | 2365 | 2884 | 6111 | 6610 | 7109 | 7608 |
| 2 | 597 | 1218 | 1847 | 2366 | 2885 | 6112 | 6611 | 7110 | 7609 |
| 3 | 598 | 1219 | 1848 | 2367 | 2886 | 6113 | 6612 | 7111 | 7610 |
| 4 | 599 | 1220 | 1849 | 2368 | 2887 | 6114 | 6613 | 7112 | 7611 |
| 5 | 600 | 1221 | 1850 | 2369 | 2888 | 6115 | 6614 | 7113 | 7612 |
| 6 | 601 | 1222 | 1851 | 2370 | 2889 | 6116 | 6615 | 7114 | 7613 |
| 7 | 602 | 1223 | 1852 | 2371 | 2890 | 6117 | 6616 | 7115 | 7614 |
| 9 | 603 | 1224 | 1853 | 2372 | 2891 | 6118 | 6617 | 7116 | 7615 |
| 10 | 604 | 1225 | 1854 | 2373 | 2892 | 6119 | 6618 | 7117 | 7616 |
| 12 | 605 | 1226 | 1855 | 2374 | 2893 | 6120 | 6619 | 7118 | 7617 |
| 13 | 606 | 1227 | 1856 | 2375 | 2894 | 6121 | 6620 | 7119 | 7618 |
| 14 | 607 | 1228 | 1857 | 2376 | 2895 | 6122 | 6621 | 7120 | 7619 |
| 17 | 610 | 1229 | 1858 | 2377 | 2896 | 6123 | 6622 | 7121 | 7620 |
| 18 | 611 | 1230 | 1859 | 2378 | 2897 | 6124 | 6623 | 7122 | 7621 |
| 19 | 613 | 1231 | 1860 | 2379 | 2898 | 6125 | 6624 | 7123 | 7622 |
| 22 | 614 | 1232 | 1861 | 2380 | 2899 | 6126 | 6625 | 7124 | 7623 |
| 24 | 616 | 1233 | 1862 | 2381 | 2900 | 6127 | 6626 | 7125 | 7624 |
| 28 | 617 | 1234 | 1863 | 2382 | 2901 | 6128 | 6627 | 7126 | 7625 |
| 33 | 618 | 1235 | 1864 | 2383 | 2902 | 6129 | 6628 | 7127 | 7626 |
| 34 | 624 | 1236 | 1865 | 2384 | 2903 | 6130 | 6629 | 7128 | 7627 |
| 35 | 625 | 1237 | 1866 | 2385 | 2904 | 6131 | 6630 | 7129 | 7628 |
| 36 | 626 | 1238 | 1867 | 2386 | 2905 | 6132 | 6631 | 7130 | 7629 |
| 37 | 628 | 1239 | 1868 | 2387 | 2906 | 6133 | 6632 | 7131 | 7630 |
| 38 | 631 | 1240 | 1869 | 2388 | 2907 | 6134 | 6633 | 7132 | 7631 |
| 39 | 632 | 1241 | 1870 | 2389 | 2908 | 6135 | 6634 | 7133 | 7632 |
| 40 | 633 | 1242 | 1871 | 2390 | 2909 | 6136 | 6635 | 7134 | 7633 |
| 41 | 634 | 1243 | 1872 | 2391 | 2910 | 6137 | 6636 | 7135 | 7634 |
| 42 | 636 | 1244 | 1873 | 2392 | 2911 | 6138 | 6637 | 7136 | 7635 |
| 43 | 638 | 1245 | 1874 | 2393 | 2912 | 6139 | 6638 | 7137 | 7636 |
| 44 | 640 | 1246 | 1875 | 2394 | 2913 | 6140 | 6639 | 7138 | 7637 |
| 45 | 645 | 1247 | 1876 | 2395 | 2914 | 6141 | 6640 | 7139 | 7638 |
| 46 | 647 | 1248 | 1877 | 2396 | 2915 | 6142 | 6641 | 7140 | 7639 |
| 47 | 648 | 1249 | 1878 | 2397 | 2916 | 6143 | 6642 | 7141 | 7640 |
| 48 | 649 | 1250 | 1879 | 2398 | 2917 | 6144 | 6643 | 7142 | 7641 |
| 49 | 650 | 1251 | 1880 | 2399 | 2918 | 6145 | 6644 | 7143 | 7642 |
| 50 | 651 | 1252 | 1881 | 2400 | 2919 | 6146 | 6645 | 7144 | 7643 |
| 51 | 652 | 1253 | 1882 | 2401 | 2920 | 6147 | 6646 | 7145 | 7644 |
| 52 | 653 | 1254 | 1883 | 2402 | 2921 | 6148 | 6647 | 7146 | 7645 |
| 53 | 654 | 1255 | 1884 | 2403 | 2922 | 6149 | 6648 | 7147 | 7646 |
| 54 | 655 | 1256 | 1885 | 2404 | 2923 | 6150 | 6649 | 7148 | 7647 |
| 55 | 656 | 1257 | 1886 | 2405 | 2924 | 6151 | 6650 | 7149 | 7648 |
| 56 | 657 | 1258 | 1887 | 2406 | 2925 | 6152 | 6651 | 7150 | 7649 |
| 57 | 659 | 1259 | 1888 | 2407 | 2926 | 6153 | 6652 | 7151 | 7650 |
| 58 | 660 | 1260 | 1889 | 2408 | 2927 | 6154 | 6653 | 7152 | 7651 |
| 59 | 661 | 1261 | 1890 | 2409 | 2928 | 6155 | 6654 | 7153 | 7652 |
| 60 | 662 | 1262 | 1891 | 2410 | 2929 | 6156 | 6655 | 7154 | 7653 |
| 61 | 663 | 1263 | 1892 | 2411 | 2930 | 6157 | 6656 | 7155 | 7654 |
| 62 | 664 | 1264 | 1893 | 2412 | 2931 | 6158 | 6657 | 7156 | 7655 |
| 63 | 666 | 1265 | 1894 | 2413 | 2932 | 6159 | 6658 | 7157 | 7656 |
| 64 | 667 | 1266 | 1895 | 2414 | 2933 | 6160 | 6659 | 7158 | 7657 |

TABLE D10-continued

Gene modifying polypeptide candidates having a Z-score of at least 1 or greater in at least one condition.
SEQ ID NOs:

| | | | | | | | | | |
|---|---|---|---|---|---|---|---|---|---|
| 65 | 668 | 1267 | 1896 | 2415 | 2934 | 6161 | 6660 | 7159 | 7658 |
| 66 | 669 | 1268 | 1897 | 2416 | 2935 | 6162 | 6661 | 7160 | 7659 |
| 67 | 670 | 1269 | 1898 | 2417 | 2936 | 6163 | 6662 | 7161 | 7660 |
| 68 | 673 | 1270 | 1899 | 2418 | 2937 | 6164 | 6663 | 7162 | 7661 |
| 69 | 674 | 1271 | 1900 | 2419 | 2938 | 6165 | 6664 | 7163 | 7662 |
| 70 | 675 | 1272 | 1901 | 2420 | 2939 | 6166 | 6665 | 7164 | 7663 |
| 71 | 676 | 1273 | 1902 | 2422 | 2940 | 6167 | 6666 | 7165 | 7664 |
| 72 | 677 | 1274 | 1903 | 2423 | 2941 | 6168 | 6667 | 7166 | 7665 |
| 73 | 678 | 1275 | 1904 | 2424 | 2942 | 6169 | 6668 | 7167 | 7666 |
| 74 | 679 | 1276 | 1905 | 2425 | 2943 | 6170 | 6669 | 7168 | 7667 |
| 75 | 680 | 1277 | 1906 | 2426 | 2944 | 6171 | 6670 | 7169 | 7668 |
| 76 | 681 | 1278 | 1907 | 2427 | 2945 | 6172 | 6671 | 7170 | 7669 |
| 77 | 684 | 1279 | 1908 | 2431 | 2946 | 6173 | 6672 | 7171 | 7670 |
| 78 | 687 | 1280 | 1909 | 2436 | 2947 | 6174 | 6673 | 7172 | 7671 |
| 79 | 689 | 1281 | 1910 | 2438 | 2948 | 6175 | 6674 | 7173 | 7672 |
| 80 | 690 | 1282 | 1911 | 2440 | 2949 | 6176 | 6675 | 7174 | 7673 |
| 81 | 692 | 1288 | 1912 | 2441 | 2950 | 6177 | 6676 | 7175 | 7674 |
| 82 | 694 | 1290 | 1913 | 2442 | 2951 | 6178 | 6677 | 7176 | 7675 |
| 83 | 700 | 1295 | 1914 | 2443 | 2952 | 6179 | 6678 | 7177 | 7676 |
| 84 | 702 | 1296 | 1915 | 2444 | 2953 | 6180 | 6679 | 7178 | 7677 |
| 85 | 704 | 1298 | 1916 | 2445 | 2954 | 6181 | 6680 | 7179 | 7678 |
| 86 | 706 | 1299 | 1917 | 2446 | 2955 | 6182 | 6681 | 7180 | 7679 |
| 87 | 707 | 1301 | 1918 | 2447 | 2957 | 6183 | 6682 | 7181 | 7680 |
| 88 | 711 | 1302 | 1919 | 2448 | 2958 | 6184 | 6683 | 7182 | 7681 |
| 89 | 715 | 1304 | 1920 | 2449 | 2959 | 6185 | 6684 | 7183 | 7682 |
| 90 | 716 | 1305 | 1921 | 2450 | 2960 | 6186 | 6685 | 7184 | 7683 |
| 91 | 717 | 1308 | 1922 | 2451 | 2962 | 6187 | 6686 | 7185 | 7684 |
| 92 | 719 | 1311 | 1923 | 2452 | 2965 | 6188 | 6687 | 7186 | 7685 |
| 93 | 720 | 1312 | 1924 | 2453 | 2966 | 6189 | 6688 | 7187 | 7686 |
| 94 | 722 | 1314 | 1925 | 2454 | 2967 | 6190 | 6689 | 7188 | 7687 |
| 95 | 724 | 1315 | 1926 | 2455 | 2968 | 6191 | 6690 | 7189 | 7688 |
| 96 | 726 | 1319 | 1927 | 2456 | 2969 | 6192 | 6691 | 7190 | 7689 |
| 97 | 727 | 1320 | 1928 | 2457 | 2970 | 6193 | 6692 | 7191 | 7690 |
| 98 | 728 | 1322 | 1929 | 2458 | 2971 | 6194 | 6693 | 7192 | 7691 |
| 99 | 729 | 1324 | 1931 | 2459 | 2972 | 6195 | 6694 | 7193 | 7692 |
| 100 | 731 | 1326 | 1932 | 2460 | 2973 | 6196 | 6695 | 7194 | 7693 |
| 101 | 738 | 1327 | 1933 | 2461 | 2974 | 6197 | 6696 | 7195 | 7694 |
| 102 | 739 | 1328 | 1934 | 2462 | 2975 | 6198 | 6697 | 7196 | 7695 |
| 103 | 740 | 1329 | 1935 | 2463 | 2976 | 6199 | 6698 | 7197 | 7696 |
| 104 | 745 | 1330 | 1936 | 2464 | 2977 | 6200 | 6699 | 7198 | 7697 |
| 105 | 746 | 1338 | 1937 | 2465 | 2978 | 6201 | 6700 | 7199 | 7698 |
| 106 | 747 | 1340 | 1938 | 2466 | 2979 | 6202 | 6701 | 7200 | 7699 |
| 107 | 755 | 1342 | 1939 | 2467 | 2980 | 6203 | 6702 | 7201 | 7700 |
| 108 | 756 | 1343 | 1940 | 2468 | 2981 | 6204 | 6703 | 7202 | 7701 |
| 110 | 759 | 1346 | 1941 | 2469 | 2982 | 6205 | 6704 | 7203 | 7702 |
| 111 | 765 | 1347 | 1942 | 2470 | 2983 | 6206 | 6705 | 7204 | 7703 |
| 112 | 766 | 1348 | 1943 | 2471 | 2984 | 6207 | 6706 | 7205 | 7704 |
| 113 | 767 | 1349 | 1944 | 2472 | 2985 | 6208 | 6707 | 7206 | 7705 |
| 114 | 768 | 1350 | 1945 | 2473 | 2986 | 6209 | 6708 | 7207 | 7706 |
| 115 | 769 | 1351 | 1946 | 2474 | 2987 | 6210 | 6709 | 7208 | 7707 |
| 116 | 770 | 1353 | 1947 | 2476 | 2988 | 6211 | 6710 | 7209 | 7708 |
| 117 | 771 | 1354 | 1948 | 2477 | 2989 | 6212 | 6711 | 7210 | 7709 |
| 118 | 772 | 1357 | 1949 | 2478 | 2990 | 6213 | 6712 | 7211 | 7710 |
| 119 | 773 | 1359 | 1950 | 2479 | 2991 | 6214 | 6713 | 7212 | 7711 |
| 120 | 774 | 1362 | 1951 | 2480 | 2992 | 6215 | 6714 | 7213 | 7712 |
| 121 | 775 | 1365 | 1952 | 2481 | 2993 | 6216 | 6715 | 7214 | 7713 |
| 122 | 776 | 1366 | 1953 | 2482 | 2994 | 6217 | 6716 | 7215 | 7714 |
| 123 | 777 | 1369 | 1954 | 2483 | 2995 | 6218 | 6717 | 7216 | 7715 |
| 124 | 780 | 1370 | 1955 | 2484 | 2996 | 6219 | 6718 | 7217 | 7716 |
| 125 | 781 | 1371 | 1956 | 2485 | 2997 | 6220 | 6719 | 7218 | 7717 |
| 126 | 782 | 1372 | 1957 | 2486 | 2998 | 6221 | 6720 | 7219 | 7718 |
| 127 | 783 | 1373 | 1958 | 2488 | 2999 | 6222 | 6721 | 7220 | 7719 |
| 128 | 784 | 1374 | 1959 | 2489 | 3001 | 6223 | 6722 | 7221 | 7720 |
| 129 | 785 | 1375 | 1960 | 2490 | 3002 | 6224 | 6723 | 7222 | 7721 |
| 130 | 789 | 1376 | 1961 | 2491 | 3003 | 6225 | 6724 | 7223 | 7722 |
| 131 | 790 | 1377 | 1962 | 2492 | 3004 | 6226 | 6725 | 7224 | 7723 |
| 132 | 794 | 1378 | 1963 | 2496 | 3005 | 6227 | 6726 | 7225 | 7724 |
| 133 | 797 | 1379 | 1964 | 2497 | 3006 | 6228 | 6727 | 7226 | 7725 |
| 134 | 798 | 1380 | 1965 | 2498 | 3007 | 6229 | 6728 | 7227 | 7726 |
| 135 | 799 | 1381 | 1966 | 2501 | 3008 | 6230 | 6729 | 7228 | 7727 |
| 136 | 800 | 1382 | 1967 | 2502 | 3009 | 6231 | 6730 | 7229 | 7728 |
| 137 | 801 | 1383 | 1968 | 2503 | 3010 | 6232 | 6731 | 7230 | 7729 |
| 138 | 802 | 1384 | 1969 | 2504 | 3011 | 6233 | 6732 | 7231 | 7730 |
| 139 | 803 | 1385 | 1970 | 2505 | 3012 | 6234 | 6733 | 7232 | 7731 |
| 140 | 804 | 1386 | 1971 | 2506 | 3013 | 6235 | 6734 | 7233 | 7732 |
| 141 | 805 | 1387 | 1972 | 2507 | 3014 | 6236 | 6735 | 7234 | 7733 |

TABLE D10-continued

Gene modifying polypeptide candidates having a Z-score of at least 1 or greater in at least one condition.
SEQ ID NOs:

| | | | | | | | | |
|---|---|---|---|---|---|---|---|---|
| 142 | 806 | 1388 | 1973 | 2508 | 3015 | 6237 | 6736 | 7235 | 7734 |
| 143 | 807 | 1389 | 1974 | 2509 | 3016 | 6238 | 6737 | 7236 | 7735 |
| 144 | 808 | 1390 | 1975 | 2510 | 3017 | 6239 | 6738 | 7237 | 7736 |
| 145 | 809 | 1391 | 1976 | 2511 | 3018 | 6240 | 6739 | 7238 | 7737 |
| 146 | 810 | 1392 | 1977 | 2512 | 3019 | 6241 | 6740 | 7239 | 7738 |
| 147 | 811 | 1393 | 1978 | 2513 | 3020 | 6242 | 6741 | 7240 | 7739 |
| 148 | 812 | 1394 | 1979 | 2514 | 3021 | 6243 | 6742 | 7241 | 7740 |
| 149 | 813 | 1395 | 1980 | 2515 | 3022 | 6244 | 6743 | 7242 | 7741 |
| 150 | 814 | 1396 | 1981 | 2516 | 3023 | 6245 | 6744 | 7243 | 7742 |
| 151 | 815 | 1397 | 1982 | 2517 | 3024 | 6246 | 6745 | 7244 | 7743 |
| 152 | 816 | 1398 | 1983 | 2518 | 3025 | 6247 | 6746 | 7245 | |
| 153 | 817 | 1399 | 1984 | 2519 | 3026 | 6248 | 6747 | 7246 | |
| 154 | 818 | 1400 | 1985 | 2520 | 3027 | 6249 | 6748 | 7247 | |
| 155 | 819 | 1401 | 1986 | 2521 | 3028 | 6250 | 6749 | 7248 | |
| 156 | 820 | 1402 | 1987 | 2522 | 3029 | 6251 | 6750 | 7249 | |
| 157 | 821 | 1403 | 1988 | 2523 | 3030 | 6252 | 6751 | 7250 | |
| 158 | 822 | 1404 | 1989 | 2524 | 3031 | 6253 | 6752 | 7251 | |
| 159 | 823 | 1405 | 1990 | 2525 | 3032 | 6254 | 6753 | 7252 | |
| 160 | 824 | 1406 | 1991 | 2526 | 3033 | 6255 | 6754 | 7253 | |
| 161 | 825 | 1407 | 1992 | 2527 | 3034 | 6256 | 6755 | 7254 | |
| 162 | 826 | 1408 | 1993 | 2528 | 3035 | 6257 | 6756 | 7255 | |
| 163 | 827 | 1409 | 1994 | 2529 | 3036 | 6258 | 6757 | 7256 | |
| 164 | 828 | 1410 | 1995 | 2530 | 3037 | 6259 | 6758 | 7257 | |
| 165 | 829 | 1411 | 1996 | 2531 | 3038 | 6260 | 6759 | 7258 | |
| 166 | 830 | 1412 | 1997 | 2532 | 3039 | 6261 | 6760 | 7259 | |
| 167 | 831 | 1413 | 1998 | 2533 | 3040 | 6262 | 6761 | 7260 | |
| 168 | 832 | 1414 | 1999 | 2534 | 3041 | 6263 | 6762 | 7261 | |
| 169 | 833 | 1415 | 2000 | 2535 | 3042 | 6264 | 6763 | 7262 | |
| 170 | 834 | 1416 | 2001 | 2536 | 3043 | 6265 | 6764 | 7263 | |
| 171 | 835 | 1417 | 2002 | 2537 | 3044 | 6266 | 6765 | 7264 | |
| 172 | 836 | 1418 | 2003 | 2538 | 3045 | 6267 | 6766 | 7265 | |
| 173 | 837 | 1419 | 2004 | 2539 | 3046 | 6268 | 6767 | 7266 | |
| 174 | 839 | 1420 | 2005 | 2540 | 3047 | 6269 | 6768 | 7267 | |
| 175 | 840 | 1421 | 2006 | 2541 | 3048 | 6270 | 6769 | 7268 | |
| 176 | 841 | 1422 | 2007 | 2542 | 3049 | 6271 | 6770 | 7269 | |
| 177 | 842 | 1423 | 2008 | 2543 | 3050 | 6272 | 6771 | 7270 | |
| 178 | 843 | 1424 | 2009 | 2544 | 3051 | 6273 | 6772 | 7271 | |
| 179 | 844 | 1425 | 2010 | 2545 | 3052 | 6274 | 6773 | 7272 | |
| 180 | 845 | 1426 | 2011 | 2546 | 3053 | 6275 | 6774 | 7273 | |
| 181 | 846 | 1427 | 2012 | 2547 | 3054 | 6276 | 6775 | 7274 | |
| 182 | 847 | 1428 | 2013 | 2548 | 3055 | 6277 | 6776 | 7275 | |
| 183 | 848 | 1429 | 2014 | 2549 | 3056 | 6278 | 6777 | 7276 | |
| 184 | 849 | 1430 | 2015 | 2550 | 3057 | 6279 | 6778 | 7277 | |
| 185 | 850 | 1431 | 2016 | 2551 | 3058 | 6280 | 6779 | 7278 | |
| 186 | 851 | 1432 | 2017 | 2552 | 3059 | 6281 | 6780 | 7279 | |
| 187 | 852 | 1433 | 2018 | 2553 | 3060 | 6282 | 6781 | 7280 | |
| 188 | 853 | 1434 | 2019 | 2554 | 3061 | 6283 | 6782 | 7281 | |
| 190 | 854 | 1435 | 2020 | 2555 | 3062 | 6284 | 6783 | 7282 | |
| 191 | 855 | 1436 | 2021 | 2556 | 3063 | 6285 | 6784 | 7283 | |
| 192 | 856 | 1437 | 2022 | 2557 | 3064 | 6286 | 6785 | 7284 | |
| 193 | 857 | 1439 | 2023 | 2558 | 3065 | 6287 | 6786 | 7285 | |
| 194 | 860 | 1440 | 2024 | 2559 | 3066 | 6288 | 6787 | 7286 | |
| 195 | 861 | 1441 | 2025 | 2560 | 3067 | 6289 | 6788 | 7287 | |
| 196 | 862 | 1442 | 2026 | 2561 | 3068 | 6290 | 6789 | 7288 | |
| 197 | 863 | 1443 | 2027 | 2562 | 3069 | 6291 | 6790 | 7289 | |
| 198 | 866 | 1444 | 2028 | 2563 | 3070 | 6292 | 6791 | 7290 | |
| 199 | 867 | 1445 | 2029 | 2564 | 3071 | 6293 | 6792 | 7291 | |
| 200 | 868 | 1446 | 2030 | 2565 | 3072 | 6294 | 6793 | 7292 | |
| 201 | 869 | 1447 | 2031 | 2566 | 3073 | 6295 | 6794 | 7293 | |
| 202 | 870 | 1448 | 2032 | 2567 | 3074 | 6296 | 6795 | 7294 | |
| 203 | 871 | 1449 | 2033 | 2568 | 3075 | 6297 | 6796 | 7295 | |
| 204 | 872 | 1450 | 2034 | 2569 | 3076 | 6298 | 6797 | 7296 | |
| 205 | 873 | 1451 | 2035 | 2570 | 3077 | 6299 | 6798 | 7297 | |
| 206 | 874 | 1452 | 2036 | 2571 | 3078 | 6300 | 6799 | 7298 | |
| 207 | 875 | 1454 | 2037 | 2572 | 3079 | 6301 | 6800 | 7299 | |
| 208 | 876 | 1455 | 2038 | 2573 | 3080 | 6302 | 6801 | 7300 | |
| 209 | 877 | 1456 | 2039 | 2574 | 3081 | 6303 | 6802 | 7301 | |
| 210 | 878 | 1460 | 2040 | 2575 | 3082 | 6304 | 6803 | 7302 | |
| 211 | 879 | 1462 | 2041 | 2576 | 3083 | 6305 | 6804 | 7303 | |
| 212 | 880 | 1465 | 2042 | 2577 | 3084 | 6306 | 6805 | 7304 | |
| 213 | 881 | 1469 | 2043 | 2578 | 3085 | 6307 | 6806 | 7305 | |
| 214 | 882 | 1471 | 2044 | 2579 | 3086 | 6308 | 6807 | 7306 | |
| 215 | 883 | 1473 | 2045 | 2580 | 3087 | 6309 | 6808 | 7307 | |
| 216 | 884 | 1475 | 2046 | 2581 | 3088 | 6310 | 6809 | 7308 | |
| 217 | 885 | 1488 | 2047 | 2582 | 3089 | 6311 | 6810 | 7309 | |
| 218 | 886 | 1489 | 2048 | 2583 | 3090 | 6312 | 6811 | 7310 | |

TABLE D10-continued

Gene modifying polypeptide candidates having a Z-score of at least 1 or greater in at least one condition.
SEQ ID NOs:

| | | | | | | | | |
|---|---|---|---|---|---|---|---|---|
| 219 | 887 | 1491 | 2049 | 2584 | 3091 | 6313 | 6812 | 7311 |
| 220 | 888 | 1492 | 2050 | 2585 | 3092 | 6314 | 6813 | 7312 |
| 221 | 889 | 1493 | 2051 | 2586 | 3093 | 6315 | 6814 | 7313 |
| 222 | 890 | 1497 | 2052 | 2587 | 3094 | 6316 | 6815 | 7314 |
| 223 | 891 | 1499 | 2053 | 2588 | 3095 | 6317 | 6816 | 7315 |
| 224 | 892 | 1504 | 2054 | 2589 | 3096 | 6318 | 6817 | 7316 |
| 225 | 893 | 1505 | 2055 | 2590 | 3097 | 6319 | 6818 | 7317 |
| 226 | 894 | 1506 | 2056 | 2591 | 3098 | 6320 | 6819 | 7318 |
| 227 | 895 | 1507 | 2057 | 2592 | 3099 | 6321 | 6820 | 7319 |
| 228 | 896 | 1508 | 2058 | 2593 | 3100 | 6322 | 6821 | 7320 |
| 229 | 897 | 1510 | 2059 | 2594 | 3101 | 6323 | 6822 | 7321 |
| 230 | 898 | 1513 | 2060 | 2595 | 3102 | 6324 | 6823 | 7322 |
| 231 | 899 | 1515 | 2061 | 2596 | 3103 | 6325 | 6824 | 7323 |
| 232 | 900 | 1519 | 2062 | 2597 | 3104 | 6326 | 6825 | 7324 |
| 233 | 901 | 1521 | 2063 | 2598 | 3105 | 6327 | 6826 | 7325 |
| 234 | 902 | 1523 | 2064 | 2599 | 3106 | 6328 | 6827 | 7326 |
| 235 | 903 | 1524 | 2066 | 2600 | 3107 | 6329 | 6828 | 7327 |
| 236 | 904 | 1527 | 2069 | 2601 | 3108 | 6330 | 6829 | 7328 |
| 237 | 905 | 1529 | 2070 | 2602 | 3109 | 6331 | 6830 | 7329 |
| 238 | 906 | 1531 | 2071 | 2603 | 3110 | 6332 | 6831 | 7330 |
| 239 | 907 | 1539 | 2072 | 2604 | 3111 | 6333 | 6832 | 7331 |
| 240 | 908 | 1540 | 2074 | 2605 | 3112 | 6334 | 6833 | 7332 |
| 241 | 909 | 1541 | 2075 | 2606 | 3113 | 6335 | 6834 | 7333 |
| 242 | 910 | 1542 | 2076 | 2607 | 3114 | 6336 | 6835 | 7334 |
| 243 | 911 | 1543 | 2079 | 2608 | 3115 | 6337 | 6836 | 7335 |
| 244 | 912 | 1544 | 2080 | 2610 | 3116 | 6338 | 6837 | 7336 |
| 245 | 913 | 1545 | 2081 | 2611 | 3117 | 6339 | 6838 | 7337 |
| 246 | 914 | 1546 | 2082 | 2612 | 3118 | 6340 | 6839 | 7338 |
| 247 | 915 | 1547 | 2084 | 2613 | 3119 | 6341 | 6840 | 7339 |
| 248 | 916 | 1548 | 2085 | 2614 | 3120 | 6342 | 6841 | 7340 |
| 249 | 917 | 1549 | 2086 | 2615 | 3121 | 6343 | 6842 | 7341 |
| 250 | 918 | 1550 | 2087 | 2616 | 3122 | 6344 | 6843 | 7342 |
| 251 | 919 | 1551 | 2088 | 2617 | 3123 | 6345 | 6844 | 7343 |
| 252 | 920 | 1552 | 2089 | 2618 | 3124 | 6346 | 6845 | 7344 |
| 253 | 921 | 1553 | 2090 | 2619 | 3125 | 6347 | 6846 | 7345 |
| 254 | 922 | 1554 | 2091 | 2620 | 3126 | 6348 | 6847 | 7346 |
| 255 | 923 | 1555 | 2092 | 2621 | 3127 | 6349 | 6848 | 7347 |
| 256 | 924 | 1556 | 2093 | 2622 | 3128 | 6350 | 6849 | 7348 |
| 257 | 925 | 1557 | 2094 | 2623 | 3129 | 6351 | 6850 | 7349 |
| 258 | 926 | 1558 | 2095 | 2624 | 3130 | 6352 | 6851 | 7350 |
| 259 | 927 | 1559 | 2096 | 2625 | 3131 | 6353 | 6852 | 7351 |
| 260 | 928 | 1560 | 2097 | 2626 | 3132 | 6354 | 6853 | 7352 |
| 261 | 929 | 1561 | 2098 | 2627 | 3133 | 6355 | 6854 | 7353 |
| 262 | 930 | 1563 | 2099 | 2628 | 3134 | 6356 | 6855 | 7354 |
| 263 | 931 | 1564 | 2100 | 2629 | 3135 | 6357 | 6856 | 7355 |
| 264 | 932 | 1565 | 2101 | 2630 | 3136 | 6358 | 6857 | 7356 |
| 265 | 933 | 1566 | 2102 | 2631 | 3138 | 6359 | 6858 | 7357 |
| 266 | 934 | 1567 | 2103 | 2632 | 3139 | 6360 | 6859 | 7358 |
| 267 | 935 | 1568 | 2104 | 2633 | 3141 | 6361 | 6860 | 7359 |
| 268 | 936 | 1570 | 2105 | 2634 | 3142 | 6362 | 6861 | 7360 |
| 269 | 937 | 1571 | 2106 | 2635 | 3144 | 6363 | 6862 | 7361 |
| 270 | 938 | 1572 | 2107 | 2636 | 3146 | 6364 | 6863 | 7362 |
| 271 | 939 | 1573 | 2108 | 2637 | 3147 | 6365 | 6864 | 7363 |
| 272 | 940 | 1574 | 2109 | 2638 | 3149 | 6366 | 6865 | 7364 |
| 273 | 941 | 1575 | 2110 | 2639 | 3152 | 6367 | 6866 | 7365 |
| 274 | 942 | 1576 | 2111 | 2640 | 3153 | 6368 | 6867 | 7366 |
| 275 | 943 | 1577 | 2112 | 2641 | 3154 | 6369 | 6868 | 7367 |
| 276 | 944 | 1578 | 2113 | 2642 | 3155 | 6370 | 6869 | 7368 |
| 277 | 945 | 1579 | 2114 | 2643 | 3157 | 6371 | 6870 | 7369 |
| 278 | 946 | 1580 | 2115 | 2644 | 3162 | 6372 | 6871 | 7370 |
| 279 | 947 | 1581 | 2116 | 2645 | 3163 | 6373 | 6872 | 7371 |
| 280 | 948 | 1582 | 2117 | 2646 | 3166 | 6374 | 6873 | 7372 |
| 281 | 950 | 1583 | 2118 | 2647 | 3167 | 6375 | 6874 | 7373 |
| 283 | 951 | 1584 | 2119 | 2648 | 3169 | 6376 | 6875 | 7374 |
| 284 | 952 | 1585 | 2120 | 2649 | 3171 | 6377 | 6876 | 7375 |
| 285 | 957 | 1587 | 2121 | 2650 | 3172 | 6378 | 6877 | 7376 |
| 286 | 958 | 1588 | 2122 | 2651 | 3173 | 6379 | 6878 | 7377 |
| 287 | 959 | 1590 | 2123 | 2652 | 3175 | 6380 | 6879 | 7378 |
| 288 | 960 | 1592 | 2124 | 2653 | 3176 | 6381 | 6880 | 7379 |
| 290 | 961 | 1593 | 2125 | 2654 | 3177 | 6382 | 6881 | 7380 |
| 292 | 962 | 1594 | 2126 | 2655 | 3180 | 6383 | 6882 | 7381 |
| 293 | 963 | 1595 | 2127 | 2656 | 3181 | 6384 | 6883 | 7382 |
| 294 | 964 | 1596 | 2128 | 2657 | 3183 | 6385 | 6884 | 7383 |
| 295 | 965 | 1597 | 2129 | 2658 | 3184 | 6386 | 6885 | 7384 |
| 296 | 966 | 1598 | 2130 | 2659 | 3188 | 6387 | 6886 | 7385 |
| 297 | 967 | 1599 | 2131 | 2660 | 3190 | 6388 | 6887 | 7386 |

TABLE D10-continued

Gene modifying polypeptide candidates having a Z-score of at least 1 or greater in at least one condition.
SEQ ID NOs:

| | | | | | | | | |
|---|---|---|---|---|---|---|---|---|
| 298 | 968 | 1600 | 2132 | 2661 | 3194 | 6389 | 6888 | 7387 |
| 299 | 969 | 1604 | 2133 | 2662 | 3196 | 6390 | 6889 | 7388 |
| 300 | 970 | 1605 | 2134 | 2663 | 3198 | 6391 | 6890 | 7389 |
| 301 | 971 | 1606 | 2135 | 2664 | 3199 | 6392 | 6891 | 7390 |
| 302 | 972 | 1607 | 2136 | 2665 | 3201 | 6393 | 6892 | 7391 |
| 303 | 973 | 1608 | 2137 | 2666 | 3202 | 6394 | 6893 | 7392 |
| 304 | 974 | 1610 | 2138 | 2667 | 3203 | 6395 | 6894 | 7393 |
| 305 | 975 | 1611 | 2139 | 2668 | 3204 | 6396 | 6895 | 7394 |
| 306 | 976 | 1612 | 2140 | 2669 | 3205 | 6397 | 6896 | 7395 |
| 307 | 977 | 1616 | 2141 | 2670 | 3206 | 6398 | 6897 | 7396 |
| 308 | 978 | 1617 | 2142 | 2671 | 3207 | 6399 | 6898 | 7397 |
| 309 | 979 | 1618 | 2143 | 2672 | 3208 | 6400 | 6899 | 7398 |
| 310 | 980 | 1619 | 2144 | 2673 | 3209 | 6401 | 6900 | 7399 |
| 311 | 981 | 1620 | 2145 | 2674 | 3211 | 6402 | 6901 | 7400 |
| 312 | 982 | 1621 | 2146 | 2675 | 3213 | 6403 | 6902 | 7401 |
| 313 | 983 | 1622 | 2147 | 2676 | 3214 | 6404 | 6903 | 7402 |
| 314 | 984 | 1623 | 2148 | 2677 | 3218 | 6405 | 6904 | 7403 |
| 315 | 985 | 1624 | 2149 | 2678 | 3219 | 6406 | 6905 | 7404 |
| 316 | 986 | 1625 | 2150 | 2679 | 3220 | 6407 | 6906 | 7405 |
| 317 | 987 | 1626 | 2151 | 2680 | 3223 | 6408 | 6907 | 7406 |
| 318 | 988 | 1627 | 2152 | 2681 | 3225 | 6409 | 6908 | 7407 |
| 319 | 989 | 1628 | 2153 | 2682 | 3228 | 6410 | 6909 | 7408 |
| 320 | 990 | 1629 | 2154 | 2683 | 3231 | 6411 | 6910 | 7409 |
| 321 | 991 | 1630 | 2155 | 2684 | 3233 | 6412 | 6911 | 7410 |
| 322 | 992 | 1631 | 2156 | 2685 | 3234 | 6413 | 6912 | 7411 |
| 323 | 993 | 1632 | 2157 | 2686 | 3235 | 6414 | 6913 | 7412 |
| 324 | 994 | 1633 | 2158 | 2687 | 3240 | 6415 | 6914 | 7413 |
| 325 | 995 | 1634 | 2159 | 2688 | 3247 | 6416 | 6915 | 7414 |
| 326 | 996 | 1635 | 2160 | 2689 | 3248 | 6417 | 6916 | 7415 |
| 327 | 997 | 1636 | 2161 | 2690 | 3251 | 6418 | 6917 | 7416 |
| 328 | 998 | 1637 | 2162 | 2691 | 3252 | 6419 | 6918 | 7417 |
| 329 | 999 | 1638 | 2163 | 2692 | 3253 | 6420 | 6919 | 7418 |
| 330 | 1000 | 1639 | 2164 | 2693 | 3254 | 6421 | 6920 | 7419 |
| 331 | 1001 | 1640 | 2165 | 2694 | 3256 | 6422 | 6921 | 7420 |
| 332 | 1002 | 1641 | 2166 | 2695 | 3259 | 6423 | 6922 | 7421 |
| 333 | 1003 | 1642 | 2167 | 2696 | 3260 | 6424 | 6923 | 7422 |
| 334 | 1004 | 1644 | 2168 | 2697 | 3261 | 6425 | 6924 | 7423 |
| 335 | 1005 | 1645 | 2169 | 2698 | 3262 | 6426 | 6925 | 7424 |
| 336 | 1006 | 1646 | 2170 | 2699 | 3263 | 6427 | 6926 | 7425 |
| 337 | 1007 | 1647 | 2171 | 2700 | 3264 | 6428 | 6927 | 7426 |
| 338 | 1008 | 1648 | 2172 | 2701 | 3265 | 6429 | 6928 | 7427 |
| 339 | 1009 | 1649 | 2173 | 2702 | 3266 | 6430 | 6929 | 7428 |
| 340 | 1010 | 1651 | 2174 | 2703 | 3268 | 6431 | 6930 | 7429 |
| 341 | 1011 | 1652 | 2175 | 2704 | 3269 | 6432 | 6931 | 7430 |
| 342 | 1012 | 1653 | 2176 | 2706 | 3270 | 6433 | 6932 | 7431 |
| 343 | 1013 | 1654 | 2177 | 2708 | 3272 | 6434 | 6933 | 7432 |
| 344 | 1014 | 1655 | 2178 | 2709 | 3276 | 6435 | 6934 | 7433 |
| 345 | 1015 | 1656 | 2179 | 2710 | 3277 | 6436 | 6935 | 7434 |
| 346 | 1016 | 1657 | 2180 | 2711 | 3279 | 6437 | 6936 | 7435 |
| 347 | 1017 | 1658 | 2181 | 2712 | 3282 | 6438 | 6937 | 7436 |
| 348 | 1018 | 1659 | 2182 | 2713 | 3283 | 6439 | 6938 | 7437 |
| 349 | 1019 | 1660 | 2183 | 2714 | 3286 | 6440 | 6939 | 7438 |
| 350 | 1020 | 1661 | 2184 | 2715 | 3294 | 6441 | 6940 | 7439 |
| 351 | 1021 | 1662 | 2185 | 2716 | 3296 | 6442 | 6941 | 7440 |
| 352 | 1022 | 1663 | 2186 | 2717 | 3298 | 6443 | 6942 | 7441 |
| 353 | 1023 | 1664 | 2187 | 2718 | 3299 | 6444 | 6943 | 7442 |
| 354 | 1024 | 1665 | 2188 | 2719 | 3300 | 6445 | 6944 | 7443 |
| 355 | 1025 | 1666 | 2189 | 2720 | 3302 | 6446 | 6945 | 7444 |
| 356 | 1026 | 1667 | 2190 | 2721 | 3303 | 6447 | 6946 | 7445 |
| 357 | 1027 | 1668 | 2191 | 2722 | 3305 | 6448 | 6947 | 7446 |
| 358 | 1028 | 1669 | 2192 | 2723 | 3306 | 6449 | 6948 | 7447 |
| 359 | 1029 | 1670 | 2193 | 2724 | 3310 | 6450 | 6949 | 7448 |
| 360 | 1030 | 1671 | 2194 | 2725 | 3313 | 6451 | 6950 | 7449 |
| 361 | 1031 | 1672 | 2195 | 2726 | 3315 | 6452 | 6951 | 7450 |
| 362 | 1032 | 1673 | 2196 | 2727 | 3316 | 6453 | 6952 | 7451 |
| 363 | 1033 | 1674 | 2197 | 2728 | 3317 | 6454 | 6953 | 7452 |
| 364 | 1034 | 1675 | 2198 | 2729 | 3318 | 6455 | 6954 | 7453 |
| 365 | 1035 | 1676 | 2199 | 2730 | 3323 | 6456 | 6955 | 7454 |
| 366 | 1036 | 1677 | 2200 | 2731 | 3326 | 6457 | 6956 | 7455 |
| 367 | 1037 | 1678 | 2201 | 2732 | 3329 | 6458 | 6957 | 7456 |
| 368 | 1038 | 1679 | 2202 | 2733 | 4501 | 6459 | 6958 | 7457 |
| 369 | 1039 | 1680 | 2203 | 2734 | 4502 | 6460 | 6959 | 7458 |
| 370 | 1040 | 1681 | 2204 | 2735 | 4503 | 6461 | 6960 | 7459 |
| 371 | 1041 | 1682 | 2205 | 2736 | 4504 | 6462 | 6961 | 7460 |
| 372 | 1042 | 1683 | 2206 | 2737 | 4505 | 6463 | 6962 | 7461 |
| 373 | 1043 | 1684 | 2207 | 2738 | 4506 | 6464 | 6963 | 7462 |

TABLE D10-continued

Gene modifying polypeptide candidates having a Z-score of at least 1 or greater in at least one condition.
SEQ ID NOs:

| | | | | | | | |
|---|---|---|---|---|---|---|---|
| 374 | 1044 | 1685 | 2208 | 2739 | 4507 | 6465 | 6964 | 7463 |
| 375 | 1045 | 1686 | 2209 | 2740 | 4508 | 6466 | 6965 | 7464 |
| 376 | 1046 | 1687 | 2210 | 2741 | 4509 | 6467 | 6966 | 7465 |
| 377 | 1047 | 1688 | 2211 | 2742 | 4510 | 6468 | 6967 | 7466 |
| 378 | 1048 | 1689 | 2212 | 2743 | 4511 | 6469 | 6968 | 7467 |
| 379 | 1049 | 1690 | 2213 | 2744 | 4512 | 6470 | 6969 | 7468 |
| 380 | 1050 | 1691 | 2214 | 2745 | 4513 | 6471 | 6970 | 7469 |
| 381 | 1051 | 1692 | 2215 | 2746 | 4514 | 6472 | 6971 | 7470 |
| 382 | 1052 | 1693 | 2218 | 2747 | 4515 | 6473 | 6972 | 7471 |
| 383 | 1053 | 1694 | 2219 | 2748 | 4516 | 6474 | 6973 | 7472 |
| 384 | 1054 | 1695 | 2220 | 2749 | 4517 | 6475 | 6974 | 7473 |
| 385 | 1055 | 1696 | 2222 | 2750 | 4518 | 6476 | 6975 | 7474 |
| 386 | 1056 | 1697 | 2223 | 2751 | 4519 | 6477 | 6976 | 7475 |
| 387 | 1057 | 1698 | 2224 | 2752 | 4520 | 6478 | 6977 | 7476 |
| 388 | 1058 | 1699 | 2225 | 2753 | 4521 | 6479 | 6978 | 7477 |
| 389 | 1059 | 1700 | 2226 | 2754 | 4522 | 6480 | 6979 | 7478 |
| 390 | 1060 | 1701 | 2227 | 2755 | 4523 | 6481 | 6980 | 7479 |
| 391 | 1061 | 1702 | 2228 | 2756 | 4524 | 6482 | 6981 | 7480 |
| 392 | 1062 | 1703 | 2229 | 2757 | 4525 | 6483 | 6982 | 7481 |
| 393 | 1063 | 1704 | 2230 | 2758 | 4526 | 6484 | 6983 | 7482 |
| 394 | 1064 | 1705 | 2231 | 2759 | 4527 | 6485 | 6984 | 7483 |
| 395 | 1065 | 1706 | 2232 | 2760 | 4528 | 6486 | 6985 | 7484 |
| 396 | 1066 | 1707 | 2233 | 2761 | 4529 | 6487 | 6986 | 7485 |
| 397 | 1067 | 1708 | 2234 | 2762 | 4530 | 6488 | 6987 | 7486 |
| 398 | 1068 | 1709 | 2235 | 2763 | 4531 | 6489 | 6988 | 7487 |
| 399 | 1069 | 1710 | 2236 | 2764 | 4532 | 6490 | 6989 | 7488 |
| 400 | 1070 | 1711 | 2237 | 2765 | 4533 | 6491 | 6990 | 7489 |
| 401 | 1071 | 1712 | 2238 | 2766 | 4534 | 6492 | 6991 | 7490 |
| 402 | 1072 | 1713 | 2239 | 2767 | 4535 | 6493 | 6992 | 7491 |
| 403 | 1073 | 1714 | 2240 | 2768 | 4536 | 6494 | 6993 | 7492 |
| 404 | 1074 | 1715 | 2241 | 2769 | 4537 | 6495 | 6994 | 7493 |
| 405 | 1075 | 1716 | 2242 | 2770 | 4538 | 6496 | 6995 | 7494 |
| 406 | 1076 | 1717 | 2243 | 2771 | 4539 | 6497 | 6996 | 7495 |
| 407 | 1077 | 1718 | 2244 | 2772 | 4540 | 6498 | 6997 | 7496 |
| 408 | 1078 | 1719 | 2245 | 2773 | 4541 | 6499 | 6998 | 7497 |
| 409 | 1079 | 1720 | 2246 | 2774 | 6001 | 6500 | 6999 | 7498 |
| 410 | 1080 | 1721 | 2247 | 2775 | 6002 | 6501 | 7000 | 7499 |
| 413 | 1081 | 1722 | 2248 | 2776 | 6003 | 6502 | 7001 | 7500 |
| 415 | 1082 | 1723 | 2249 | 2777 | 6004 | 6503 | 7002 | 7501 |
| 416 | 1083 | 1724 | 2250 | 2778 | 6005 | 6504 | 7003 | 7502 |
| 419 | 1084 | 1725 | 2251 | 2779 | 6006 | 6505 | 7004 | 7503 |
| 420 | 1085 | 1726 | 2252 | 2780 | 6007 | 6506 | 7005 | 7504 |
| 421 | 1086 | 1727 | 2253 | 2781 | 6008 | 6507 | 7006 | 7505 |
| 423 | 1087 | 1728 | 2254 | 2782 | 6009 | 6508 | 7007 | 7506 |
| 424 | 1088 | 1729 | 2255 | 2783 | 6010 | 6509 | 7008 | 7507 |
| 426 | 1089 | 1730 | 2256 | 2784 | 6011 | 6510 | 7009 | 7508 |
| 427 | 1090 | 1731 | 2257 | 2785 | 6012 | 6511 | 7010 | 7509 |
| 428 | 1091 | 1733 | 2259 | 2786 | 6013 | 6512 | 7011 | 7510 |
| 429 | 1092 | 1734 | 2260 | 2787 | 6014 | 6513 | 7012 | 7511 |
| 432 | 1093 | 1735 | 2261 | 2788 | 6015 | 6514 | 7013 | 7512 |
| 433 | 1094 | 1736 | 2262 | 2789 | 6016 | 6515 | 7014 | 7513 |
| 437 | 1095 | 1737 | 2263 | 2790 | 6017 | 6516 | 7015 | 7514 |
| 438 | 1096 | 1738 | 2264 | 2791 | 6018 | 6517 | 7016 | 7515 |
| 441 | 1097 | 1739 | 2265 | 2792 | 6019 | 6518 | 7017 | 7516 |
| 443 | 1103 | 1740 | 2266 | 2793 | 6020 | 6519 | 7018 | 7517 |
| 446 | 1110 | 1741 | 2268 | 2794 | 6021 | 6520 | 7019 | 7518 |
| 449 | 1115 | 1742 | 2270 | 2795 | 6022 | 6521 | 7020 | 7519 |
| 450 | 1116 | 1743 | 2271 | 2796 | 6023 | 6522 | 7021 | 7520 |
| 452 | 1117 | 1744 | 2272 | 2797 | 6024 | 6523 | 7022 | 7521 |
| 460 | 1118 | 1745 | 2273 | 2798 | 6025 | 6524 | 7023 | 7522 |
| 461 | 1119 | 1746 | 2274 | 2799 | 6026 | 6525 | 7024 | 7523 |
| 462 | 1120 | 1747 | 2275 | 2800 | 6027 | 6526 | 7025 | 7524 |
| 464 | 1121 | 1748 | 2276 | 2801 | 6028 | 6527 | 7026 | 7525 |
| 465 | 1122 | 1750 | 2277 | 2802 | 6029 | 6528 | 7027 | 7526 |
| 469 | 1123 | 1751 | 2278 | 2803 | 6030 | 6529 | 7028 | 7527 |
| 470 | 1124 | 1752 | 2279 | 2804 | 6031 | 6530 | 7029 | 7528 |
| 472 | 1126 | 1753 | 2280 | 2805 | 6032 | 6531 | 7030 | 7529 |
| 474 | 1127 | 1754 | 2281 | 2806 | 6033 | 6532 | 7031 | 7530 |
| 475 | 1129 | 1755 | 2282 | 2807 | 6034 | 6533 | 7032 | 7531 |
| 476 | 1131 | 1756 | 2283 | 2808 | 6035 | 6534 | 7033 | 7532 |
| 480 | 1134 | 1757 | 2286 | 2809 | 6036 | 6535 | 7034 | 7533 |
| 481 | 1136 | 1758 | 2287 | 2810 | 6037 | 6536 | 7035 | 7534 |
| 483 | 1137 | 1759 | 2288 | 2811 | 6038 | 6537 | 7036 | 7535 |
| 484 | 1138 | 1760 | 2289 | 2812 | 6039 | 6538 | 7037 | 7536 |
| 486 | 1139 | 1761 | 2291 | 2813 | 6040 | 6539 | 7038 | 7537 |
| 488 | 1140 | 1762 | 2292 | 2814 | 6041 | 6540 | 7039 | 7538 |

TABLE D10-continued

Gene modifying polypeptide candidates having a Z-score of at least 1 or greater in at least one condition.
SEQ ID NOs:

| | | | | | | | |
|---|---|---|---|---|---|---|---|
| 489 | 1141 | 1764 | 2293 | 2815 | 6042 | 6541 | 7040 | 7539 |
| 495 | 1142 | 1765 | 2294 | 2816 | 6043 | 6542 | 7041 | 7540 |
| 498 | 1143 | 1766 | 2295 | 2817 | 6044 | 6543 | 7042 | 7541 |
| 499 | 1144 | 1767 | 2299 | 2818 | 6045 | 6544 | 7043 | 7542 |
| 502 | 1145 | 1768 | 2300 | 2819 | 6046 | 6545 | 7044 | 7543 |
| 503 | 1146 | 1769 | 2301 | 2820 | 6047 | 6546 | 7045 | 7544 |
| 504 | 1147 | 1770 | 2302 | 2821 | 6048 | 6547 | 7046 | 7545 |
| 510 | 1148 | 1771 | 2303 | 2822 | 6049 | 6548 | 7047 | 7546 |
| 517 | 1149 | 1772 | 2304 | 2823 | 6050 | 6549 | 7048 | 7547 |
| 519 | 1150 | 1773 | 2305 | 2824 | 6051 | 6550 | 7049 | 7548 |
| 522 | 1151 | 1774 | 2306 | 2825 | 6052 | 6551 | 7050 | 7549 |
| 523 | 1152 | 1775 | 2307 | 2826 | 6053 | 6552 | 7051 | 7550 |
| 524 | 1153 | 1776 | 2308 | 2827 | 6054 | 6553 | 7052 | 7551 |
| 527 | 1154 | 1777 | 2309 | 2828 | 6055 | 6554 | 7053 | 7552 |
| 528 | 1155 | 1778 | 2310 | 2829 | 6056 | 6555 | 7054 | 7553 |
| 532 | 1156 | 1779 | 2311 | 2830 | 6057 | 6556 | 7055 | 7554 |
| 534 | 1157 | 1780 | 2312 | 2831 | 6058 | 6557 | 7056 | 7555 |
| 535 | 1158 | 1781 | 2313 | 2832 | 6059 | 6558 | 7057 | 7556 |
| 536 | 1159 | 1782 | 2314 | 2833 | 6060 | 6559 | 7058 | 7557 |
| 537 | 1160 | 1783 | 2315 | 2834 | 6061 | 6560 | 7059 | 7558 |
| 538 | 1161 | 1784 | 2316 | 2835 | 6062 | 6561 | 7060 | 7559 |
| 539 | 1162 | 1785 | 2317 | 2836 | 6063 | 6562 | 7061 | 7560 |
| 540 | 1163 | 1786 | 2318 | 2837 | 6064 | 6563 | 7062 | 7561 |
| 541 | 1164 | 1787 | 2319 | 2838 | 6065 | 6564 | 7063 | 7562 |
| 542 | 1165 | 1788 | 2320 | 2839 | 6066 | 6565 | 7064 | 7563 |
| 543 | 1166 | 1789 | 2321 | 2840 | 6067 | 6566 | 7065 | 7564 |
| 544 | 1167 | 1790 | 2322 | 2841 | 6068 | 6567 | 7066 | 7565 |
| 545 | 1168 | 1791 | 2323 | 2842 | 6069 | 6568 | 7067 | 7566 |
| 546 | 1169 | 1792 | 2324 | 2843 | 6070 | 6569 | 7068 | 7567 |
| 547 | 1170 | 1793 | 2325 | 2844 | 6071 | 6570 | 7069 | 7568 |
| 548 | 1171 | 1794 | 2326 | 2845 | 6072 | 6571 | 7070 | 7569 |
| 549 | 1172 | 1795 | 2327 | 2846 | 6073 | 6572 | 7071 | 7570 |
| 550 | 1173 | 1796 | 2328 | 2847 | 6074 | 6573 | 7072 | 7571 |
| 553 | 1174 | 1797 | 2329 | 2848 | 6075 | 6574 | 7073 | 7572 |
| 554 | 1176 | 1799 | 2330 | 2849 | 6076 | 6575 | 7074 | 7573 |
| 555 | 1177 | 1800 | 2331 | 2850 | 6077 | 6576 | 7075 | 7574 |
| 556 | 1178 | 1801 | 2332 | 2851 | 6078 | 6577 | 7076 | 7575 |
| 557 | 1179 | 1802 | 2333 | 2852 | 6079 | 6578 | 7077 | 7576 |
| 558 | 1181 | 1803 | 2334 | 2853 | 6080 | 6579 | 7078 | 7577 |
| 559 | 1182 | 1804 | 2335 | 2854 | 6081 | 6580 | 7079 | 7578 |
| 560 | 1184 | 1805 | 2336 | 2855 | 6082 | 6581 | 7080 | 7579 |
| 561 | 1185 | 1806 | 2337 | 2856 | 6083 | 6582 | 7081 | 7580 |
| 562 | 1186 | 1808 | 2338 | 2857 | 6084 | 6583 | 7082 | 7581 |
| 563 | 1187 | 1809 | 2339 | 2858 | 6085 | 6584 | 7083 | 7582 |
| 564 | 1188 | 1810 | 2340 | 2859 | 6086 | 6585 | 7084 | 7583 |
| 565 | 1190 | 1811 | 2341 | 2860 | 6087 | 6586 | 7085 | 7584 |
| 566 | 1193 | 1812 | 2342 | 2861 | 6088 | 6587 | 7086 | 7585 |
| 567 | 1195 | 1813 | 2343 | 2862 | 6089 | 6588 | 7087 | 7586 |
| 568 | 1196 | 1815 | 2344 | 2863 | 6090 | 6589 | 7088 | 7587 |
| 569 | 1197 | 1816 | 2345 | 2864 | 6091 | 6590 | 7089 | 7588 |
| 570 | 1198 | 1817 | 2346 | 2865 | 6092 | 6591 | 7090 | 7589 |
| 571 | 1199 | 1818 | 2347 | 2866 | 6093 | 6592 | 7091 | 7590 |
| 572 | 1200 | 1819 | 2348 | 2867 | 6094 | 6593 | 7092 | 7591 |
| 575 | 1201 | 1823 | 2349 | 2868 | 6095 | 6594 | 7093 | 7592 |
| 580 | 1202 | 1824 | 2350 | 2869 | 6096 | 6595 | 7094 | 7593 |
| 581 | 1203 | 1825 | 2351 | 2870 | 6097 | 6596 | 7095 | 7594 |
| 583 | 1204 | 1827 | 2352 | 2871 | 6098 | 6597 | 7096 | 7595 |
| 584 | 1205 | 1828 | 2353 | 2872 | 6099 | 6598 | 7097 | 7596 |
| 585 | 1206 | 1829 | 2354 | 2873 | 6100 | 6599 | 7098 | 7597 |
| 586 | 1207 | 1831 | 2355 | 2874 | 6101 | 6600 | 7099 | 7598 |
| 587 | 1208 | 1832 | 2356 | 2875 | 6102 | 6601 | 7100 | 7599 |
| 588 | 1209 | 1834 | 2357 | 2876 | 6103 | 6602 | 7101 | 7600 |
| 589 | 1210 | 1835 | 2358 | 2877 | 6104 | 6603 | 7102 | 7601 |
| 590 | 1211 | 1838 | 2359 | 2878 | 6105 | 6604 | 7103 | 7602 |
| 591 | 1212 | 1840 | 2360 | 2879 | 6106 | 6605 | 7104 | 7603 |
| 592 | 1213 | 1842 | 2361 | 2880 | 6107 | 6606 | 7105 | 7604 |
| 593 | 1214 | 1843 | 2362 | 2881 | 6108 | 6607 | 7106 | 7605 |
| 594 | 1215 | 1844 | 2363 | 2882 | 6109 | 6608 | 7107 | 7606 |
| 595 | 1216 | 1845 | 2364 | 2883 | 6110 | 6609 | 7108 | 7607 |

As the results in this example establish, gene modifying polypeptides combining linkers selected from those shown in Table 10 and RTs from 17 retroviral RT families out of the 35 RT families screened have gene editing activity when delivered as DNA to test cells.

Example 4: Evaluating the Effects of RT Domain Mutations on Editing Activity in Pooled Screen The pooled screen data using the library from Example 3 was further analyzed to evaluate the effect of mutations, within and across RT families, on candidate gene modifying polypeptide editing activity. The RT families included RT domains comprising one or more substitutions at positions corresponding to 200, 603, 330, 524, 562, 583, 51, 67, 67, 197, 204, 302, 309, 313, 435, 454, 594, 671, 69, or 653 of murine leukemia virus reverse transcriptase relative to a wildtype sequence of the RT domain. Without wishing to be bound by theory, it is thought that substitutions at positions corresponding to one or more of these positions may improve stability (e.g., thermostability) and/or editing activity of the RT domain and/or a gene modifying polypeptide comprising the same. Specific combinations of mutations tested included those listed in Table 2.

FIGS. 8A-8F, 9A-9H, and 10A-10C show graphs of average Z score for candidate gene modifying polypeptides grouped by RT variant (X-axis) and RT family (each box).

FIGS. 8A-8F show that for several RT families (MLVAV, MLVBM, BAEVM, FLV, FOAMV, and GALV), gene modifying polypeptide candidates comprising RT variants without mutations have negative or near 0 average Z-scores, whereas those comprising RT variants with one or more mutations at the specified sites have positive average Z-scores which increase with the number of positions substituted. These results show that mutations at one or more of the positions suspected of stabilizing/increasing editing activity rescue RT domains of these families, resulting in active or more active candidate gene modifying polypeptides relative to gene candidates with an RT lacking substitutions.

FIGS. 9A-9H show that for several RT families (KORV, AVIRE, MLVCB, MLVFF, MLVMS, SFV3L, WMSV, and XMRV6), gene modifying polypeptide candidates comprising RT variants without mutations have positive average Z-scores and those comprising RT variants with one or more mutations at the specified sites have higher average Z-scores which increase with the number of positions substituted. These results show that for eight of the RT families tested, mutations at one or more of the positions suspected of stabilizing/increasing editing activity further improve the activity of already active RT domains in these families, resulting in more active candidate gene modifying polypeptides.

Figures 10A, 10B, 10C:
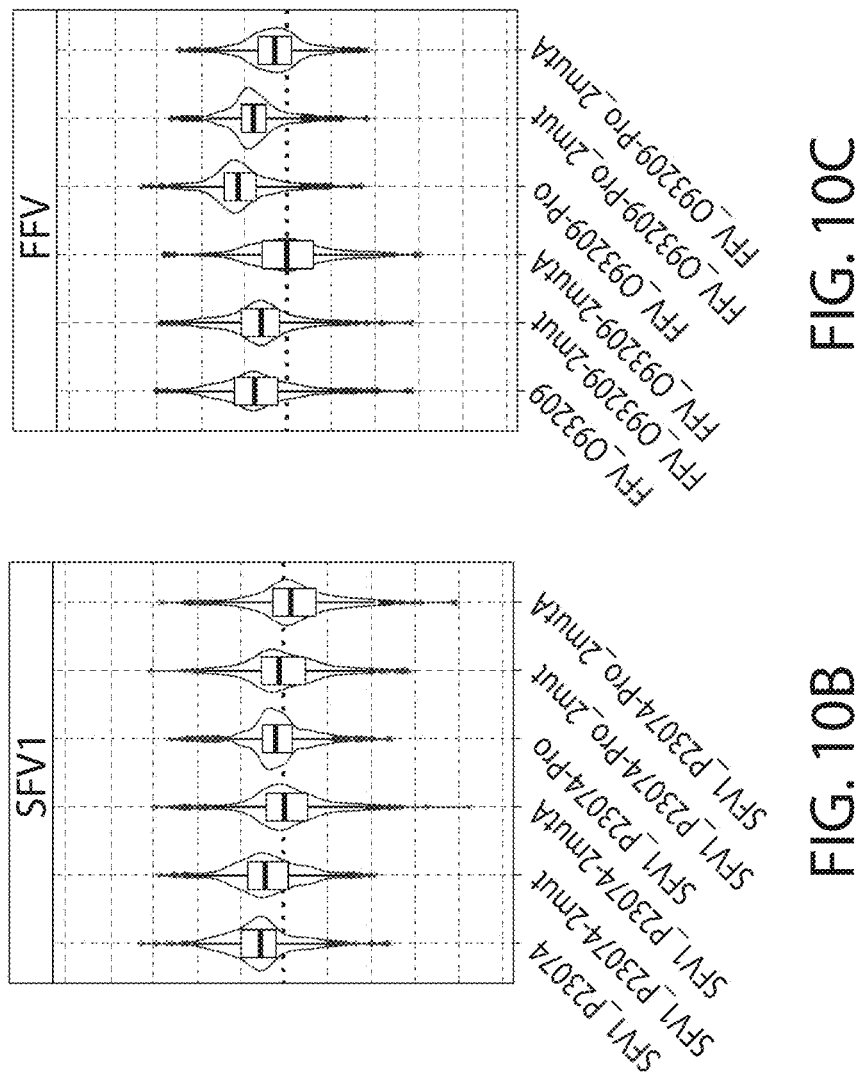
FIGS. 10A-10C provide violin plots showing enrichment of exemplary gene modifying polypeptides grouped by RT family (FIG. 10A PERV, FIG. 10B SFV1, FIG. 10C FFV), where the wild-type RT family gene modifying polypeptide is given at left, followed at right by gene modifying polypeptides comprising an increasing number of substitution mutations. For SFV1 and FFV RT families, variants deleting/disabling the protease domain of the RT domain were also evaluated.

FIGS. 10A-10C show that for several RT families that show editing activity in Example 3 (PERV, SFV1, and FFV), gene modifying polypeptide candidates comprising RT variants without mutations have similar average Z-scores to those comprising RT variants with one or more mutations at the specified sites, or have lower average Z-scores that decrease with the number of positions substituted. These results show that the effect of mutations is not predictable as evidenced by the fact that, for some editing-active RT families, mutations at one or more of the positions suspected of stabilizing/increasing editing activity have no or little effect on editing activity, or decrease the editing activity of the gene modifying polypeptide.

These results demonstrate that RT domain mutations at one or more positions corresponding to 200, 603, 330, 524, 562, 583, 51, 67, 67, 197, 204, 302, 309, 313, 435, 454, 594, 671, 69, or 653 of murine leukemia virus reverse transcriptase can increase editing activity of gene modifying polypeptides derived from certain RT families and not others. In particular, editing activity of candidate gene modifying polypeptides containing RT domains of RT families MLVAV, MLVBM, BAEVM, FLV, FOAMV, GALV, KORV, AVIRE, MLVCB, MLVFF, MLVMS, SFV3L, WMSV, and XMRV6 was increased by substitutions at the listed positions, and that the more substitutions in the RT variant, the greater the increase in editing activity. The RT families identified as active in Example 3 where substitutions improved editing activity were nearly all derived from Gammaretroviruses, with one gammaretroviral RT family (PERV) showing no effect on editing activity from the substitutions. Both of the RT families identified as active in Example 3 where substitutions negatively correlated with editing activity were Spumavirus RTs.

Example 5: Evaluating the Effects of Different Linkers on Editing Activity in Pooled Screen The pooled screen data using the library from Example 3 was further analyzed to evaluate the effect of different linkers, within and across RT families, on candidate gene modifying polypeptide editing activity.

Figure 11:
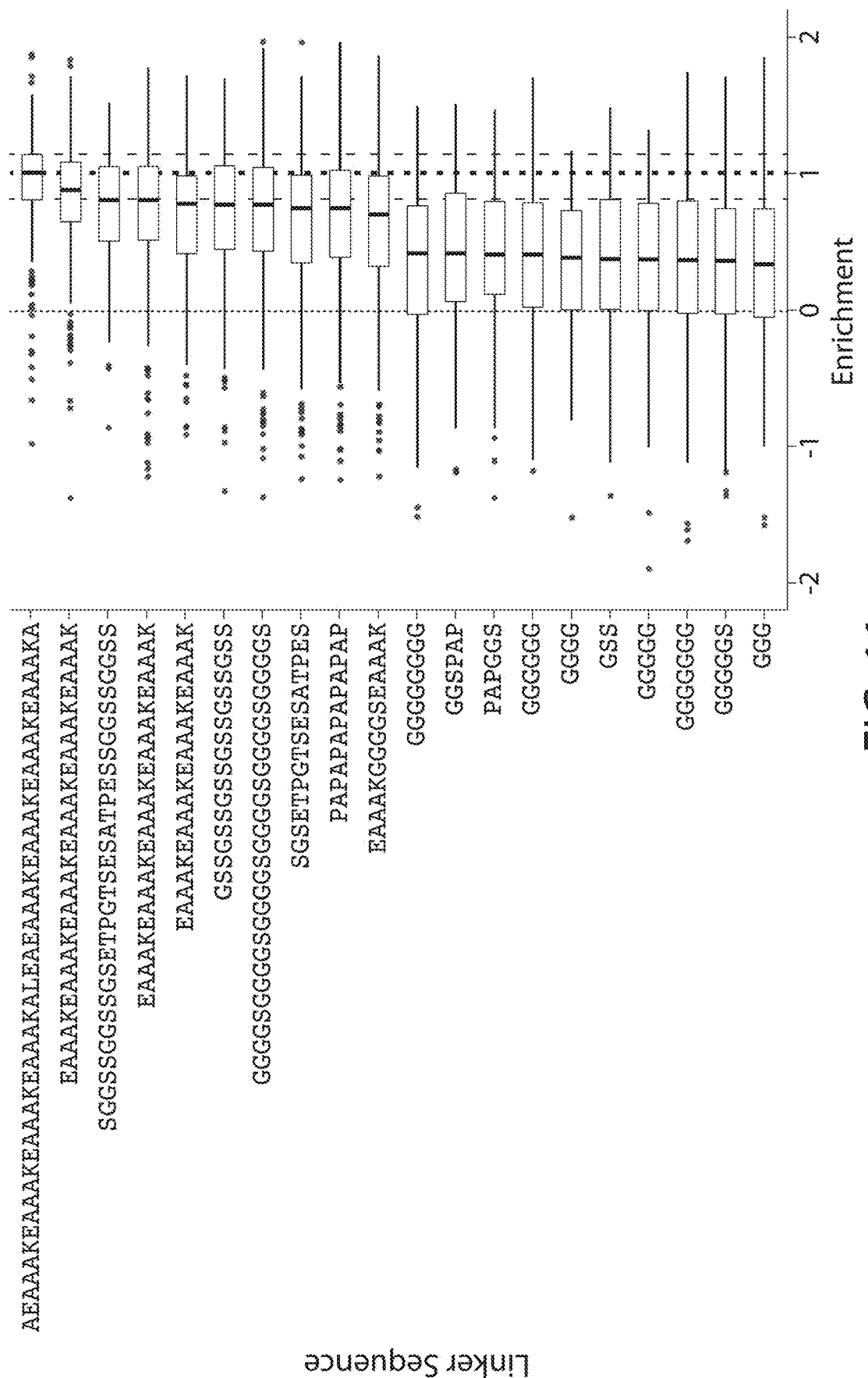
FIG. 11 provides box and whisker graphs of enrichment of a selection of exemplary gene modifying polypeptides grouped by linker, where the square dotted line indicates the average enrichment of gene modifying polypeptides comprising the top performing linker and the dashed dotted lines indicate the standard error of the mean around said average enrichment. Figure discloses SEQ ID NOS 5217, 5130, 5006, 5129, 5128, 5124, 5112, 5220, 5136, 5219, 5118, 5143-5144, 5116, 5114-5115, 5117 and 5138, respectively, in order of appearance.

FIG. 11 shows a graph of average Z score for candidate gene modifying polypeptides grouped by linker (Y-axis) for select linkers, with lines indicating the average and standard error of the mean from the highest performing linker. The results show that candidate gene modifying polypeptides containing a (SEQ ID NO: 11,041)
AEAAAKEAAAKEAAAKEAAAKALEAEAAAKEAAAKEAAAKEAAAKA linker consistently show high editing activity. The results further suggest that some linkers, e.g., those listed in Table A2, show higher editing activity than some other linkers tested.

TABLE A2

Exemplary Linkers

| Amino Acid Sequence | SEQ ID NO: |
|---|---|
| AEAAAKEAAAKEAAAKEAAAKALEAEAAAKEAAAKEAAAKEAAAKA | 11,041 |
| EAAAKEAAAKEAAAKEAAAKEAAAKEAAAK | 11,042 |
| SGGSSGGSSGSETPGTSESATPESSGGSSGGSS | 11,043 |
| EAAAKEAAAKEAAAKEAAAKEAAAK | 11,044 |
| EAAAKEAAAKEAAAKEAAAK | 11,045 |
| GSSGSSGSSGSSGSSGSS | 11,046 |
| GGGGSGGGGSGGGGSGGGGSGGGGSGGGGS | 11,047 |
| SGSETPGTSESATPES | 11,048 |
| PAPAPAPAPAPAP | 11,049 |
| EAAAKGGGGSEAAAK | 11,050 |

Example 6: Characterizing Editing Activity of Exemplary Gene Modifying Polypeptides Delivered in RNA Form to Several Model Systems FIG. 12A-12D show graphs of editing activity of four exemplary gene modifying polypeptides delivered as RNA in different experimental model systems, each gene modifying polypeptide comprising the AEAAAKEAAAKEAAAKEAAAKALE-AEAAAKEAAAKEAAAKEAAAKA (SEQ ID NO: 11,041) linker. The amino acid sequences of the exemplary gene modifying polypeptides are given in the below table.

TABLE A3

Exemplary Gene Modifying Polypeptides

| Exemplary Gene Modifying Polypeptide | Full AA Sequence |
|---|---|
| 1 | MPAAKRVKLDGGDKKYSIGLDIGTNSVGWAVITDEYKVPSKKFKVLGNTDRHSIKKNLIGALLFDS GETAEATRLKRTARRRYTRRKNRICYLQEIFSNEMAKVDDSFFHRLEESFLVEEDKKHERHPIFGN IVDEVAYHEKYPTIYHLRKKLVDSTDKADLRLIYLALAHMIKFRGHFLIEGDLNPDNSDVDKLFIQ LVQTYNQLFEENPINASGVDAKAILSARLSKSRRLENLIAQLPGEKKNGLFGNLIALSLGLTPNFK SNFDLAEDAKLQLSKDTYDDDLDNLLAQIGDQYADLFLAAKNLSDAILLSDILRVNTEITKAPLSA SMIKRYDEHHQDLTLLKALVRQQLPEKYKEIFFDQSKNGYAGYIDGGASQEEFYKFIKPILEKMDG TEELLVKLNREDLLRKQRTFDNGSIPHQIHLGELHAILRRQEDFYPPLKDNREKIEKILTFRIPYY VGPLARGNSRFAWMTRKSEETITPWNFEEVVDKGASAQSFIERMTNFDKNLPNEKVLPKHSLLYEY FTVYNELTKVKYVTEGMRKPAFLSGEQKKAIVDLLFKTNRKVTVKQLKEDYFKKIECFDSVEISGV EDRFNASLGTYHDLLKIIKDKDFLDNEENEDILEDIVLTLTLFEDREMIEERLKTYAHLFDDKVMK QLKRRRYTGWGRLSRKLINGIRDKQSGKTILDFLKSDGFANRNFMQLIHDDSLTFKEDIQKAQVSG QGDSLHEHIANLAGSPAIKKGILQTVKVVDELVKVMGRHKPENIVIEMARENQTTQKGQKNSRERM KRIEEGIKELGSQILKEHPVENTQLQNEKLYLYYLQNGRDMYVDQELDINRLSDYDVDHIVPQSFL KDDSIDNKVLTRSDKARGKSDNVPSEEVVKKMKNYWRQLLNAKLITQRKFDNLTKAERGGLSELDK AGFIKRQLVETRQITKHVAQILDSRMNTKYDENDKLIREVKVITLKSKLVSDFRKDFQFYKVREIN NYHHAHDAYLNAVVGTALIKKYPKLESEFVYGDYKVYDVRKMIAKSEQEIGKATAKYFFYSNIMNF FKTEITLANGEIRKRPLIETNGETGEIVWDKGRDFATVRKVLSMPQVNIVKKTEVQTGGFSKESIL PKRNSDKLIARKKDWDPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELALPSKYVNFLYLASHYE KLKGSPEDNEQKQLFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDLSQLGGDGGAEAAA KEAAAKEAAAKEAAAKALEAEAAAKEAAAKEAAAKAGGTAPLEEEYRLFLEAPIQNVTLLE QWKREIPKVWAEINPPGLASTQAPIHVQLLSTALPVRVRQYPITLEAKRSLRETIRKFRAAGILRP VHSPWNTPLLPVRKSGTSEYRMVQDLREVNKRVETIHPTVPNPYTLLSLLPPDRIWYSVLDLKDAF FCIPLAPESQLIFAFEWADAEEGESGQLTWTRLPQGFKNSPTLFNEALNRDLQGFRLDHPSVSLLQ YVDDLLIAADTQAACLSATRDLLMTLAELGYRVSGKKAQLCQEEVTYLGFKIHKGSRSLSNSRTQA ILQIPVPKTKRQVREFLGKIGYCRLFIPGFAELAQPLYAATRPGNDPLVWGEKEEEAFQSLKLALT QPPALALPSLDKPFQLFVEETSGAAKGVLTQALGPWKRPVAYLSKRLDPVAAGWPRCLRAIAAAAL LTREASKLTFGQDIEITSSHNLESLLRSPPDKWLTNARITQYQVLLLDPPRVRFKQTAALNPATLL PETDDTLPIHHCLDTLDSLTSTRPDLTDQPLAQAEATLFTDGSSYIRDGKRYAGAAVVTLDSVIWA EPLPIGTSAQKAELIALTKALEWSKDKSVNIYTDSRYAFATLHVHGMIYRERGWLTAGGKAIKNAP EILALLTAVWLPKRVAVMHCKGHQKDDAPTSTGNRRADEVAREVAIRPLSTQATISAGKRTADGSE FEKRTADGSEFESPKKKAKVE (SEQ ID NO: 11,091) |
| 2 | MPAAKRVKLDGGDKKYSIGLDIGTNSVGWAVITDEYKVPSKKFKVLGNTDRHSIKKNLIGALLFDS GETAEATRLKRTARRRYTRRKNRICYLQEIFSNEMAKVDDSFFHRLEESFLVEEDKKHERHPIFGN IVDEVAYHEKYPTIYHLRKKLVDSTDKADLRLIYLALAHMIKFRGHFLIEGDLNPDNSDVDKLFIQ LVQTYNQLFEENPINASGVDAKAILSARLSKSRRLENLIAQLPGEKKNGLFGNLIALSLGLTPNFK SNFDLAEDAKLQLSKDTYDDDLDNLLAQIGDQYADLFLAAKNLSDAILLSDILRVNTEITKAPLSA SMIKRYDEHHQDLTLLKALVRQQLPEKYKEIFFDQSKNGYAGYIDGGASQEEFYKFIKPILEKMDG TEELLVKLNREDLLRKQRTFDNGSIPHQIHLGELHAILRRQEDFYPPLKDNREKIEKILTFRIPYY VGPLARGNSRFAWMTRKSEETITPWNFEEVVDKGASAQSFIERMTNFDKNLPNEKVLPKHSLLYEY FTVYNELTKVKYVTEGMRKPAFLSGEQKKAIVDLLFKTNRKVTVKQLKEDYFKKIECFDSVEISGV EDRFNASLGTYHDLLKIIKDKDFLDNEENEDILEDIVLTLTLFEDREMIEERLKTYAHLFDDKVMK QLKRRRYTGWGRLSRKLINGIRDKQSGKTILDFLKSDGFANRNFMQLIHDDSLTFKEDIQKAQVSG QGDSLHEHIANLAGSPAIKKGILQTVKVVDELVKVMGRHKPENIVIEMARENQTTQKGQKNSRERM KRIEEGIKELGSQILKEHPVENTQLQNEKLYLYYLQNGRDMYVDQELDINRLSDYDVDHIVPQSFL KDDSIDNKVLTRSDKARGKSDNVPSEEVVKKMKNYWRQLLNAKLITQRKFDNLTKAERGGLSELDK AGFIKRQLVETRQITKHVAQILDSRMNTKYDENDKLIREVKVITLKSKLVSDFRKDFQFYKVREIN NYHHAHDAYLNAVVGTALIKKYPKLESEFVYGDYKVYDVRKMIAKSEQEIGKATAKYFFYSNIMNF FKTEITLANGEIRKRPLIETNGETGEIVWDKGRDFATVRKVLSMPQVNIVKKTEVQTGGFSKESIL PKRNSDKLIARKKDWDPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELALPSKYVNFLYLASHYE KLKGSPEDNEQKQLFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDLSQLGGDGGAEAAA KEAAAKEAAAKEAAAKALEAEAAAKEAAAKEAAAKEAAAKAGGTLQLEEEYRLFEPESTQKQEMDI WLKNFPQAWAETGGMGTAHCQAPVLIQLKATATPISIRQYPMPHEAYQGIKPHIRRMLDQGILKPC QSPWNTPLLPVKKPGTEDYRPVQDLREVNKRVEDIHPTVPNPYNLLSTLPPSHPWYTVLDLKDAFF CLRLHSESQLLFAFEWRDPEIGLSGQLTWTRLPQGFKNSPTLFNEALHSDLADFRVRYPALVLLQY VDDLLLAAATRTECLEGTKALLETLGNKGYRASAKKAQICLQEVTYLGYSLKDGQRWLTKARKEAI LSIPVPKNSRQVREFLGKAGYCRLFIPGFAELAAPLYPLTRPGTLFQWGTEQQLAFEDIKKALLSS PALGLPDITKPFELFIDENSGFAKGVLVQKLGPWKRPVAYLSKKLDTVASGWPPCLRMVAAIAILV KDAGKLTLGQPLTILTSHPVEALVRQPPNKWLSNARMTHYQAMLLDAERVHFGPTVSLNPATLLPL PSGGNHHDCLQILAETHGTRPDLTDQPLPDADLTWYTDGSSFIRNGEREAGAAVTTESEVIWAAPL |

TABLE A3-continued

Exemplary Gene Modifying Polypeptides

| Exemplary Gene Modifying Polypeptide | Full AA Sequence |
| --- | --- |
| | PPGTSAQRAELIALTQALKMAEGKKLTVYTDSRYAFATTHVHGEIYRRRGWLTSEGKEIKNKNEIL ALLEALFLPKRLSIIHCPGHQKGDSPQAKGNRLADDTAKKAATETHSSLTVLPAGKRTADGSEFEK RTADGSEFESPKKKAKVE (SEQ ID NO: 11,092) |
| 3 | MPAAKRVKLDGGDKKYSIGLDIGTNSVGWAVITDEYKVPSKKFKVLGNTDRHSIKKNLIGALLFDS GETAEATRLKRTARRRYTRRKNRICYLQEIFSNEMAKVDDSFFHRLEESFLVEEDKKHERHPIFGN IVDEVAYHEKYPTIYHLRKKLVDSTDKADLRLIYLALAHMIKFRGHFLIEGDLNPDNSDVDKLFIQ LVQTYNQLFEENPINASGVDAKAILSARLSKSRRLENLIAQLPGEKKNGLFGNLIALSLGLTPNFK SNFDLAEDAKLQLSKDTYDDDLDNLLAQIGDQYADLFLAAKNLSDAILLSDILRVNTEITKAPLSA SMIKRYDEHHQDLTLLKALVRQQLPEKYKEIFFDQSKNGYAGYIDGGASQEEFYKFIKPILEKMDG TEELLVKLNREDLLRKQRTFDNGSIPHQIHLGELHAILRRQEDFYPFLKDNREKIEKILTFRIPYY VGPLARGNSRFAWMTRKSEETITPWNFEEVVDKGASAQSFIERMTNFDKNLPNEKVLPKHSLLYEY FTVYNELTKVKYVTEGMRKPAFLSGEQKKAIVDLLFKTNRKVTVKQLKEDYFKKIECFDSVEISGV EDRFNASLGTYHDLLKIIKDKDFLDNEENEDILEDIVLTLTLFEDREMIEERLKTYAHLFDDKVMK QLKRRRYTGWGRLSRKLINGIRDKQSGKTILDFLKSDGFANRNFMQLIHDDSLTFKEDIQKAQVSG QGDSLHEHIANLAGSPAIKKGILQTVKVVDELVKVMGRHKPENIVIEMARENQTTQKGQKNSRERM KRIEEGIKELGSQILKEHPVENTQLQNEKLYLYYLQNGRDMYVDQELDINRLSDYDVDHIVPQSFL KDDSIDNKVLTRSDKARGKSDNVPSEEVVKKMKNYWRQLLNAKLITQRKFDNLTKAERGGLSELDK AGFIKRQLVETRQITKHVAQILDSRMNTKYDENDKLIREVKVITLKSKLVSDFRKDFQFYKVREIN NYHHAHDAYLNAVVGTALIKKYPKLESEFVYGDYKVYDVRKMIAKSEQEIGKATAKYFFYSNIMNF FKTEITLANGEIRKRPLIETNGETGEIVWDKGRDFATVRKVLSMPQVNIVKKTEVQTGGFSKESIL PKRNSDKLIARKKDWDPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELALPSKYVNFLYLASHYE KLKGSPEDNEQKQLFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDLSQLGGDGGAEAAA KEAAAKEAAAKEAAAKALEAEAAAKEAAAKEAAAKEAAAKAGGTLNIEDEHRLHETSKEPDVSLGS TWLSDFPQAWAETGGMGLAVRQAPLIIPLKATSTPVSIKQYPMSQEARLGIKPHIQRLLDQGILVP CQSPWNTPLLPVKKPGTNDYRPVQDLREVNKRVEDIHPTVPNPYNLLSGLPPSHQWYTVLDLKDAF FCLRLHPTSQPLFAFEWRDPEMGISGQLTWTRLPQGFKNSPTLFNEALHRDLADFRIQHPDLILLQ YVDDLLLAATSELDCQQGTRALLQTLGNLGYRASAKKAQICQKQVKYLGYLLKEGQRWLTEARKET VMGQPTPKTPRQLREFLGKAGFCRLFIPGFAEMAAPLYPLTKPGTLFNWGPDQQKAYQEIKQALLT APALGLPDLTKPFELFVDEKQGYAKGVLTQKLGPWRRPVAYLSKKLDPVAAGWPPCLRMVAAIAVL TKDAGKLTMGQPLVILAPHAVEALVKQPPDRWLSNARMTHYQALLLDTDRVQFGPVVALNPATLLP LPEEGLQHNCLDILAEAHGTRPDLTDQPLPDADHTWYTDGSSLLQEGQRKAGAAVTTETEVIWAKA LPAGTSAQRAELIALTQALKMAEGKKLNVYTDSRYAFATAHIGHEIYRRRGWLTSEGKEIKNKDEI LALLLKALFLPKRLSIIHCPGHQKGHSAEARGNRMADQAARKAAITETPDTSTLLAGKRTADGSEFE KRTADGSEFESPKKKAKVE (SEQ ID NO: 11,093) |
| 4 | MPAAKRVKLDGGDKKYSIGLDIGTNSVGWAVITDEYKVPSKKFKVLGNTDRHSIKKNLIGALLFDS GETAEATRLKRTARRRYTRRKNRICYLQEIFSNEMAKVDDSFFHRLEESFLVEEDKKHERHPIFGN IVDEVAYHEKYPTIYHLRKKLVDSTDKADLRLIYLALAHMIKFRGHFLIEGDLNPDNSDVDKLFIQ LVQTYNQLFEENPINASGVDAKAILSARLSKSRRLENLIAQLPGEKKNGLFGNLIALSLGLTPNFK SNFDLAEDAKLQLSKDTYDDDLDNLLAQIGDQYADLFLAAKNLSDAILLSDILRVNTEITKAPLSA SMIKRYDEHHQDLTLLKALVRQQLPEKYKEIFFDQSKNGYAGYIDGGASQEEFYKFIKPILEKMDG TEELLVKLNREDLLRKQRTFDNGSIPHQIHLGELHAILRRQEDFYPFLKDNREKIEKILTFRIPYY VGPLARGNSRFAWMTRKSEETITPWNFEEVVDKGASAQSFIERMTNFDKNLPNEKVLPKHSLLYEY FTVYNELTKVKYVTEGMRKPAFLSGEQKKAIVDLLFKTNRKVTVKQLKEDYFKKIECFDSVEISGV EDRFNASLGTYHDLLKIIKDKDFLDNEENEDILEDIVLTLTLFEDREMIEERLKTYAHLFDDKVMK QLKRRRYTGWGRLSRKLINGIRDKQSGKTILDFLKSDGFANRNFMQLIHDDSLTFKEDIQKAQVSG QGDSLHEHIANLAGSPAIKKGILQTVKVVDELVKVMGRHKPENIVIEMARENQTTQKGQKNSRERM KRIEEGIKELGSQILKEHPVENTQLQNEKLYLYYLQNGRDMYVDQELDINRLSDYDVDHIVPQSFL KDDSIDNKVLTRSDKARGKSDNVPSEEVVKKMKNYWRQLLNAKLITQRKFDNLTKAERGGLSELDK AGFIKRQLVETRQITKHVAQILDSRMNTKYDENDKLIREVKVITLKSKLVSDFRKDFQFYKVREIN NYHHAHDAYLNAVVGTALIKKYPKLESEFVYGDYKVYDVRKMIAKSEQEIGKATAKYFFYSNIMNF FKTEITLANGEIRKRPLIETNGETGEIVWDKGRDFATVRKVLSMPQVNIVKKTEVQTGGFSKESIL PKRNSDKLIARKKDWDPKKYGGFDSPTVAYSVLVVAKVEKGKSKKLKSVKELLGITIMERSSFEKN PIDFLEAKGYKEVKKDLIIKLPKYSLFELENGRKRMLASAGELQKGNELALPSKYVNFLYLASHYE KLKGSPEDNEQKQLFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDLSQLGGDGGAEAAA KEAAAKEAAAKEAAAKALEAEAAAKEAAAKEAAAKEAAAKAGGMDPLQLLQPLEAEIKGTKLKAHW NSGATITCVPQAFLEEEVPIKNIWIKTIHGEKEQPVYYLTFKIQGRKVEAEVISSSPYDYILVSPSD IPWLMKKPLQLTTLVPLQEYEERLLKQTMLTGSYKEKLQSLFLKYDALWQHWENQVGHRRIKPHHI ATGTVNPRPQKQYPINPKAKASIQTVINDLLKQGVLIQQNSIMNTPVYPVPKPDGKWRMVLDYREV NKTIPLIAAQNQHSAGILSSIFRGKYKTTLDLSNGFWAHSITPESYWLTAFTWLGQQYCWTRLPQG FLNSPALFNADVVDLLKEVPNVQVYVDDIYISHDDPREHLEQLEKVFSLLLNAGYVVSLKKSEIAQ HEVEFLGFNITKEGRGLTETFQKLLNITPPRDLKQLQSILGKLNFARNFIPNFSELVKPLYNIIA TAPGKYITWTTDNSQQLQNIISMLNSAENLEERNPEVRLIMKVNTSPSAGYIRFYNEFAKRPIMYL NYVYTKAEVKFTNTEKLLTTIHKGLIKALDLGMGQEILVYSPIVSMTKIQKTPLPERKALPIRWIT WMSYLEDPRIQFHYDKTLPELQQVPTVTDDIIAKIKHPSEFSMVFYTDGSAIKHPNVNKSHNAGMG |

TABLE A3-continued

Exemplary Gene Modifying Polypeptides

| Exemplary Gene Modifying Polypeptide | Full AA Sequence |
|---|---|
| | IAQVQFKPEFTVINTWSIPLGDHTAQLAEVAAVEFACKKALKIDGPVLIVTDSFYVAESVNKELPY WQSNGFFNNKKKPLKHVSKWKSIADCIQLKPDIIIHEKGHQPTASTFHTEGNNLADKLATQGSYV VNAGKRTADGSEFEKRTADGSEFESPKKKAKVE (SEQ ID NO: 11,094) |

Figure 12A:
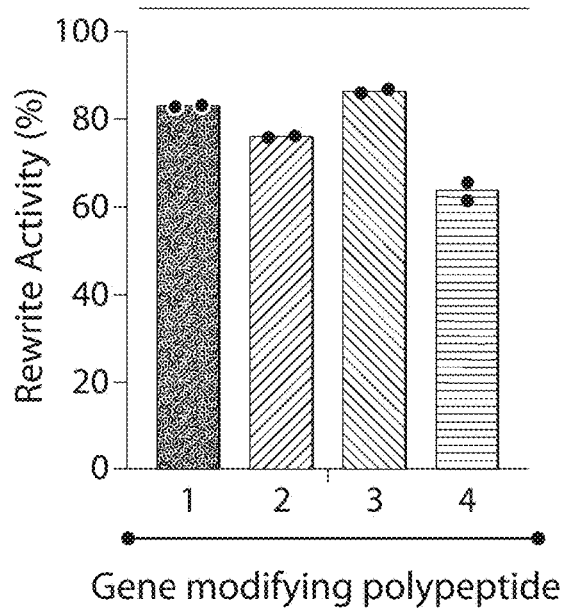
FIGS. 12A-12D show graphs of editing activity of exemplary gene modifying polypeptides when editing is targeted to a genomic landing pad BFP gene in U2OS cells (FIG. 12A), when editing is targeted to HEK3 in U2OS cells (FIG. 12B), when editing is targeted to murine Fah in primary murine hepatocytes (FIG. 12C), and when editing is targeted to murine Fah in the liver of Fah5981SB model mice (FIG. 12D).

U2OS cells comprising a BFP landing pad (as described in Example 1 for HEK293T cells) were nucleofected with mRNA encoding one of the exemplary gene modifying polypeptides along with a template RNA designed to convert BFP to GFP, as described herein (FIG. 12A). The relative amounts of GFP positive cells (successfully edited) and BFP positive cells (unedited cells) were determined by flow cytometry and used to determine the editing activities of the gene modifying polypeptides in this experimental system. The results showed that all four exemplary gene modifying polypeptides showed high editing activity (from about 60% to over 85%).

Figure 12B:
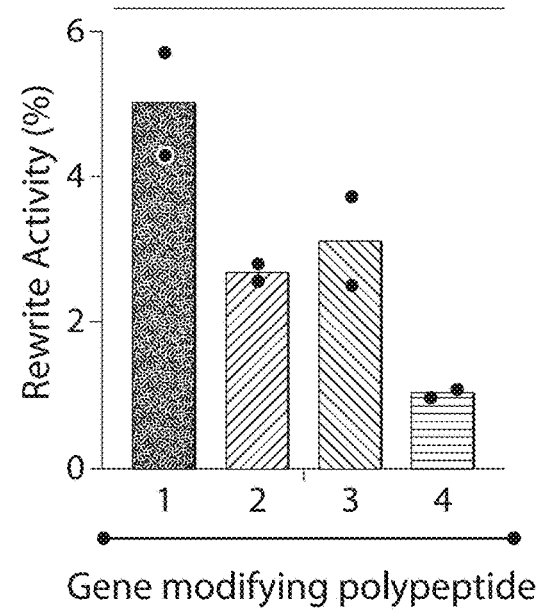

U2OS cells were nucleofected with mRNA encoding one of the exemplary gene modifying polypeptides along with a template RNA designed to edit the HEK3 locus and a second strand-targeting gRNA (FIG. 12B). Editing was confirmed by amplicon sequencing using primers specific for the target locus. The results showed that all four exemplary gene modifying polypeptides showed editing activity at the HEK3 locus (from about 1% to about 5%).

Figure 12C:
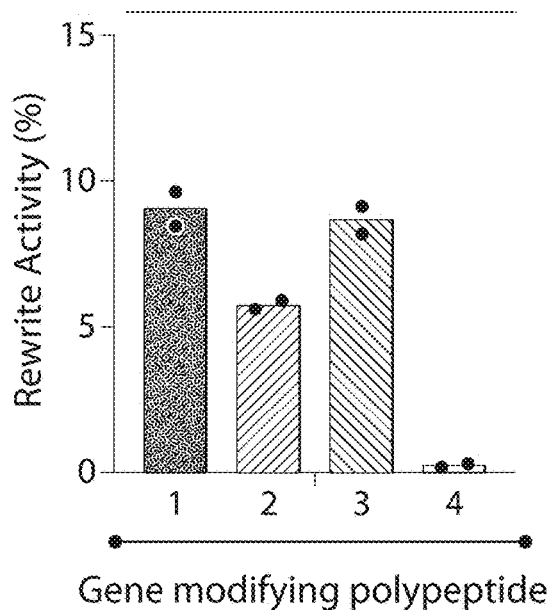

Primary murine hepatocytes were nucleofected with mRNA encoding one of the exemplary gene modifying polypeptides along with a second strand-targeting gRNA and a template RNA designed to convert a G nucleotide to an A nucleotide in the endogenous Fah locus in wildtype mouse primary hepatocytes (FIG. 12C). A mutation in the last nucleotide of exon 8 of the Fah gene leads to aberrant mRNA splicing and subsequent mRNA degradation, without the production of Fah protein and, and thus serves as a mouse model of hereditary tyrosinemia type I; editing said nucleotide from G to A demonstrates the ability of a gene modifying system to target the mouse model's relevant locus. Editing was confirmed by amplicon sequencing using primers specific for the murine Fah target locus. The results showed that three of the four exemplary gene modifying polypeptides showed editing activity at the murine Fah locus (from about 6% to about 9%).

Figure 12D:
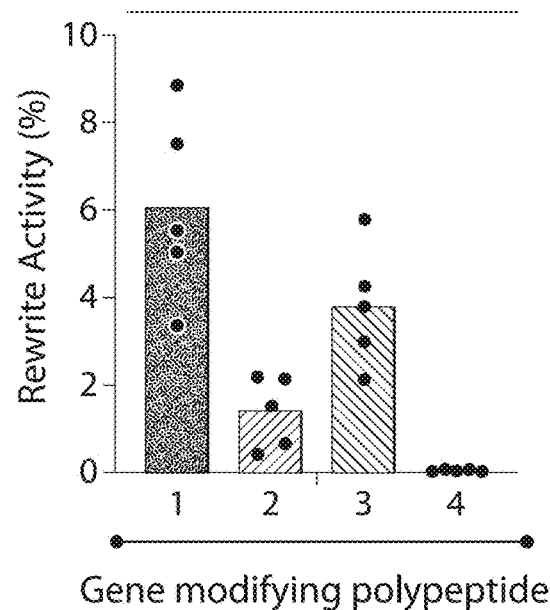

The gene modifying system comprising mRNA encoding one of the exemplary gene modifying polypeptides and a template RNA were formulated in LNP and delivered to Fah5981SB mice (FIG. 12D). The template RNA was designed to convert an A nucleotide to a G nucleotide in the Fah5981SB mouse model into the endogenous Fah locus in mouse liver. The Fah5981 SB mouse model harbors a G to A point mutation in the last nucleotide of exon 8 of the Fah gene, leading to aberrant mRNA splicing and subsequent mRNA degradation, without the production of Fah protein and serves as a mouse model of hereditary tyrosinemia type I. Specifically, 2 mg/kg of total RNA equivalent formulated in LNPs, combined at 1:1 (w/w) of template RNA and mRNA, were dosed intravenously in 7 to 9-week-old, mixed gender Fah5981SB mice. 6 days post-dosing animals were sacrificed, and their liver collected for analyses. To analyze gene editing activity, primers flanking the target insertion site locus were used to amplify across the locus in the genomic DNA of liver samples collected 6 days post-dosing. Amplicons were analyzed via short read sequencing using an Illumina MiSeq. Conversion of an A nucleotide to a G nucleotide indicates successful editing. Results showed that three of the four exemplary gene modifying polypeptides showed editing activity in vivo in murine liver (from about 1.2% to about 6%).

Taken together, FIGS. 12A-12D show that the RNA delivery of several exemplary gene modifying polypeptides can achieve significant editing activity across different target loci, in different cell types, and in vivo at a therapeutically relevant locus. Additionally, the results further demonstrate that exemplary gene modifying polypeptides comprising a

```
                                        (SEQ ID NO: 11,041)
AEAAAKEAAAKEAAAKEAAAKALEAEAAAKEAAAKEAAAKEAAAKA
``` linker, shown in Example 5 to be particularly effective in gene modifying polypeptides, can be used to achieve significant editing activity across different target loci, in different cell types, and in vivo at a therapeutically relevant locus. Additionally, the results further demonstrate that exemplary gene modifying polypeptides comprising RT domains from the SSFV, MMLV, AVIRE, or SSV RT families can achieve editing activity across different target loci, in different cell types, and in vivo at a therapeutically relevant locus.

Example 7: Characterizing the Editing Activity of 39 High Performing Exemplary Gene Modifying Polypeptides This example describes characterization of the editing activity of a selection of 39 exemplary gene modifying polypeptides chosen from those identified in the preceding Examples based on their performance in the pooled RT family experiments. As described above, each gene modifying polypeptide contains Cas9 linked to a reverse transcriptase (RT). Specifically, this example describes the introduction of a gene modifying polypeptide to mammalian cells via lentiviral transduction, such that the RNA encoding the gene modifying polypeptide is reverse transcribed, integrated into the genome, and stably expressed in the mammalian cells, followed by transfection of a template guide RNA for in vitro editing, as a means of evaluating the editing activity of the individual gene modifying polypeptide.

In this example, exemplary gene modifying polypeptides comprised the following combinations of linkers and RT domains fused to a Cas9 domain:

| Graph ID | Linker amino acid sequence | SEQ ID NO: | RT Variant Name |
|---|---|---|---|
| 10373 | PAPGGSGGG | 11,051 | MLVMS_P03355_PLV919 |
| 13642 | GSSEAAAKGGG | 11,052 | MLVAV_P03356_3mutA |
| 12793 | EAAAKPAPGGS | 11,053 | MLVCB_P08361_3mutA |
| 13522 | GSSGGGEAAAK | 11,054 | MLVMS_P03355_3mutA_WS |
| 16382 | PAPGSSEAAAK | 11,055 | MLVMS_P03355_3mutA_WS |
| 9438 | GGGEAAAKGGS | 11,056 | XMRV6_A1Z651_3mutA |
| 16661 | AEAAAKEAAAKEAAAKEAAAKALEAEAAAKEAAAKEAAAKEAAAKA | 11,057 | MLVMS_P03355_PLV919 |
| 5077 | PAPAPAPAPAPAP | 11,058 | MLVFF_P26809_3mutA |
| 14944 | GGGEAAAKPAP | 11,059 | MLVFF_P26809_3mutA |
| 15953 | GSSPAPEAAAK | 11,060 | MLVMS_P03355_3mutA_WS |
| 5082 | PAPAPAPAPAPAP | 11,061 | MLVMS_P03355_PLV919 |
| 13233 | GGGGSSEAAAK | 11,062 | MLVMS_P03355_PLV919 |
| 5071 | PAPAPAPAPAPAP | 11,063 | MLVCB_P08361_3mutA |
| 17380 | SGGSSGGSSGSETPGTSESATPESSGGSSGGSS | 11,064 | MLVMS_P03355_PLV919 |
| 12507 | GGSPAPEAAAK | 11,065 | MLVCB_P08361_3mutA |
| 4213 | EAAAKEAAAKEAAAKEAAAKEAAAKEAAAK | 11,066 | MLVCB_P08361_3mutA |
| 12438 | GGSEAAAKPAP | 11,067 | WMSV_P03359_3mutA |
| 16591 | AEAAAKEAAAKEAAAKEAAAKALEAEAAAKEAAAKEAAAKEAAAKA | 11,068 | AVIRE_P03360_3mutA |
| 3927 | EAAAKEAAAKEAAAKEAAAK | 11,069 | MLVCB_P08361_3mutA |
| 16664 | AEAAAKEAAAKEAAAKEAAAKALEAEAAAKEAAAKEAAAKEAAAKA | 11,070 | MLVMS_P03355_3mutA_WS |
| 12807 | EAAAKPAPGGS | 11,071 | MLVMS_P03355_3mutA_WS |
| 1576 | GGGGSGGGGSGGGGSGGGGSGGGGSGGGGS | 11,072 | AVIRE_P03360_3mutA |
| 1646 | GGGGSGGGGSGGGGSGGGGSGGGGSGGGGS | 11,073 | MLVMS_P03355_PLV919 |
| 14586 | GSSPAPGGG | 11,074 | XMRV6_A1Z651_3mutA |
| 14652 | PAPGGGGSS | 11,075 | MLVCB_P08361_3mutA |
| 1353 | GGGGSGGGGSGGGGSGGGGS | 11,076 | MLVCB_P08361_3mutA |
| 9370 | GGGEAAAKGGS | 11,077 | MLVMS_P03355_3mut |
| 6831 | EAAAKGGG | 11,078 | PERV_Q4VFZ2_3mut |
| 12513 | GGSPAPEAAAK | 11,079 | MLVFF_P26809_3mutA |
| 15021 | GGGPAPEAAAK | 11,080 | BAEVM_P10272_3mutA |
| 8576 | GGGGSSGGS | 11,081 | WMSV_P03359_3mut |
| 16609 | AEAAAKEAAAKEAAAKEAAAKALEAEAAAKEAAAKEAAAKEAAAKA | 11,082 | FLV_P10273_3mutA |
| 12691 | EAAAKGGSPAP | 11,083 | PERV_Q4VFZ2_3mut |
| 15894 | GSSPAPEAAAK | 11,084 | FLV_P10273_3mutA |
| 14924 | GGGEAAAKPAP | 11,085 | KORV_Q9TTC1-Pro_3mutA |
| 16704 | AEAAAKEAAAKEAAAKEAAAKALEAEAAAKEAAAKEAAAKEAAAKA | 11,086 | SFV1_P23074_2mutA |
| 4925 | PAPAPAPAPAP | 11,087 | MLVBM_Q7SVK7_3mut |

-continued

| Graph ID | Linker amino acid sequence | SEQ ID NO: | RT Variant Name |
|---|---|---|---|
| 11771 | GSSGGSPAP | 11,088 | HTLV2_P03363 |
| 707 | GGSGGSGGSGGSGGS | 11,089 | WDSV_092815 |

The exemplary gene modifying polypeptides were introduced to HEK293T cells carrying a BFP-expressing genomic landing pad by transfection of mRNA. To determine the editing activity of the gene modifying polypeptide, BFP-expressing cells containing the gene modifying polypeptide—are electroporated with a template RNA designed to convert BFP-to-GFP. Cells were analyzed using flow cytometry for expression of the color-converted fluorescent protein 3-4 days post electroporation.

Figure 13:
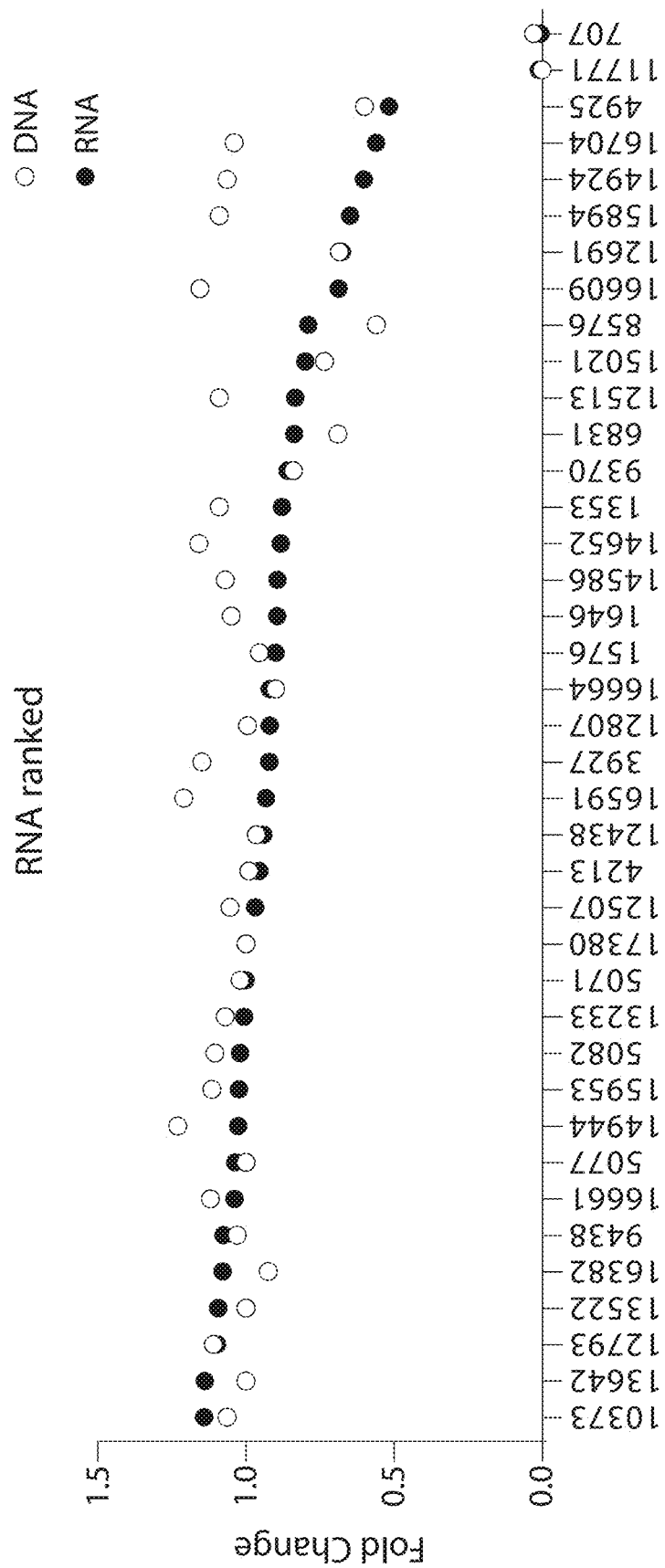
FIG. 13 shows a graph of enrichment of a selection of exemplary gene modifying polypeptides after being provided to cells as a plasmid (DNA) or as mRNA.

FIG. 13 shows a graph of the editing activity for the 39 exemplary gene modifying polypeptides when delivered to HEK293T cells in DNA (plasmid) form or RNA (mRNA) form along with an exemplary template RNA. The results showed that a gene modifying polypeptide can be delivered to cells in the form of mRNA and achieve comparable editing activity as the same gene modifying polypeptide delivered to cells in the form of DNA. Additionally, these results demonstrate that the gene modifying systems described herein can be delivered entirely in RNA form (e.g., via mRNA encoding the gene modifying polypeptide and a template RNA).

Example 8: Arrayed Screening of Individual Gene Modifying Polypeptides in HEK293T and U2OS Cells This example describes identification and characterization of several classes of gene modifying polypeptides capable of editing genomic DNA.

Figure 15:
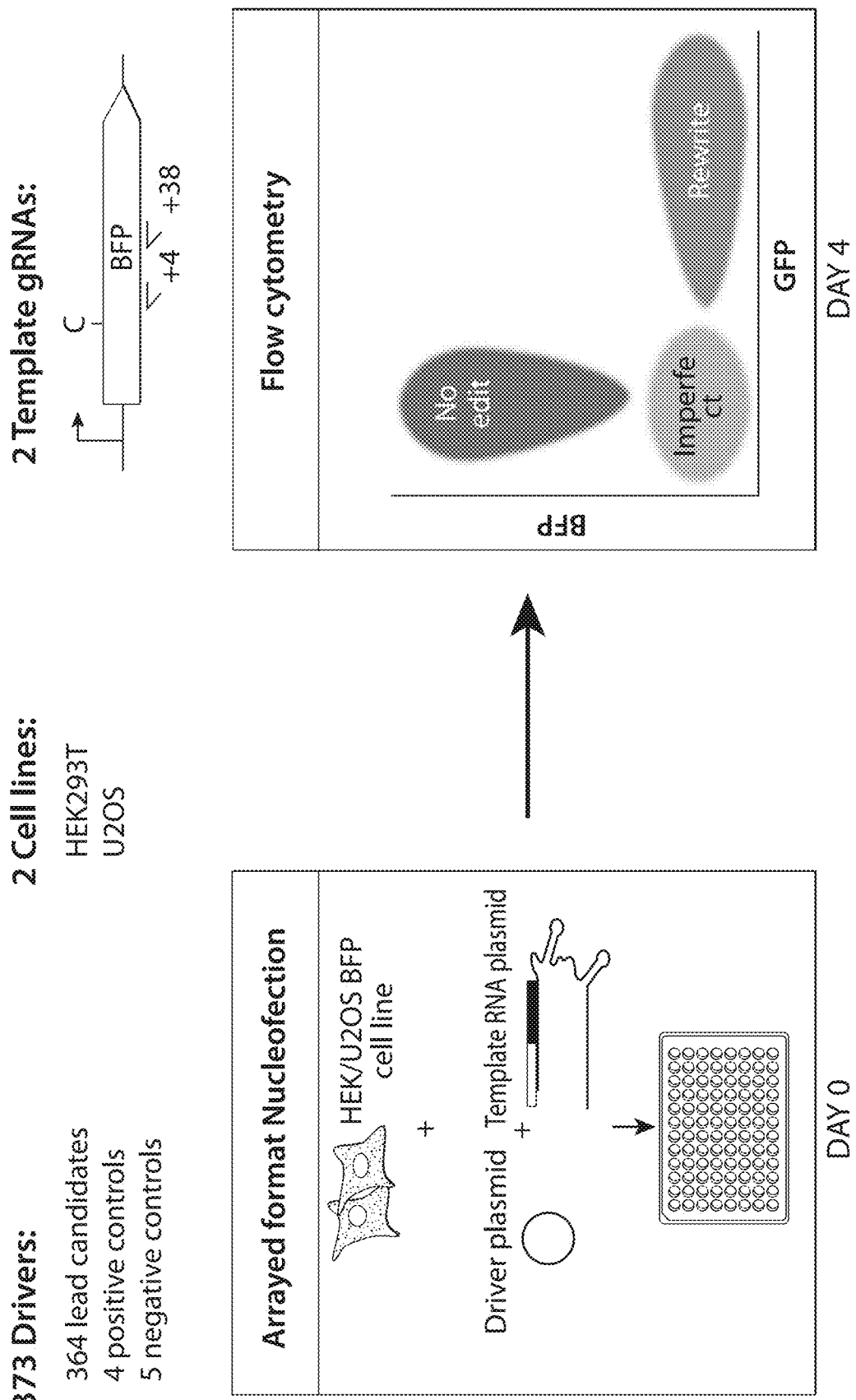
FIG. 15 is a diagram showing a workflow for arrayed screening of gene modifying polypeptides using flow cytometry.

HEK293T cells or U2OS cells expressing BFP (as described in preceding Examples) were nucleofected with a plasmid expressing one of 373 gene modifying polypeptides and a plasmid expressing either exemplary tgRNA g4 or exemplary tgRNA g10 (each designed to convert BFP to GFP) on day 0, and then flow cytometry was used to analyze BFP and GFP expression on day 4 (FIG. 15). Cells having GFP signal were defined as having undergone a successful rewriting event, and the percent of cells that were GFP± on day 4 was used to determined the performance of each gene modifying polypeptide.

Figure 16:
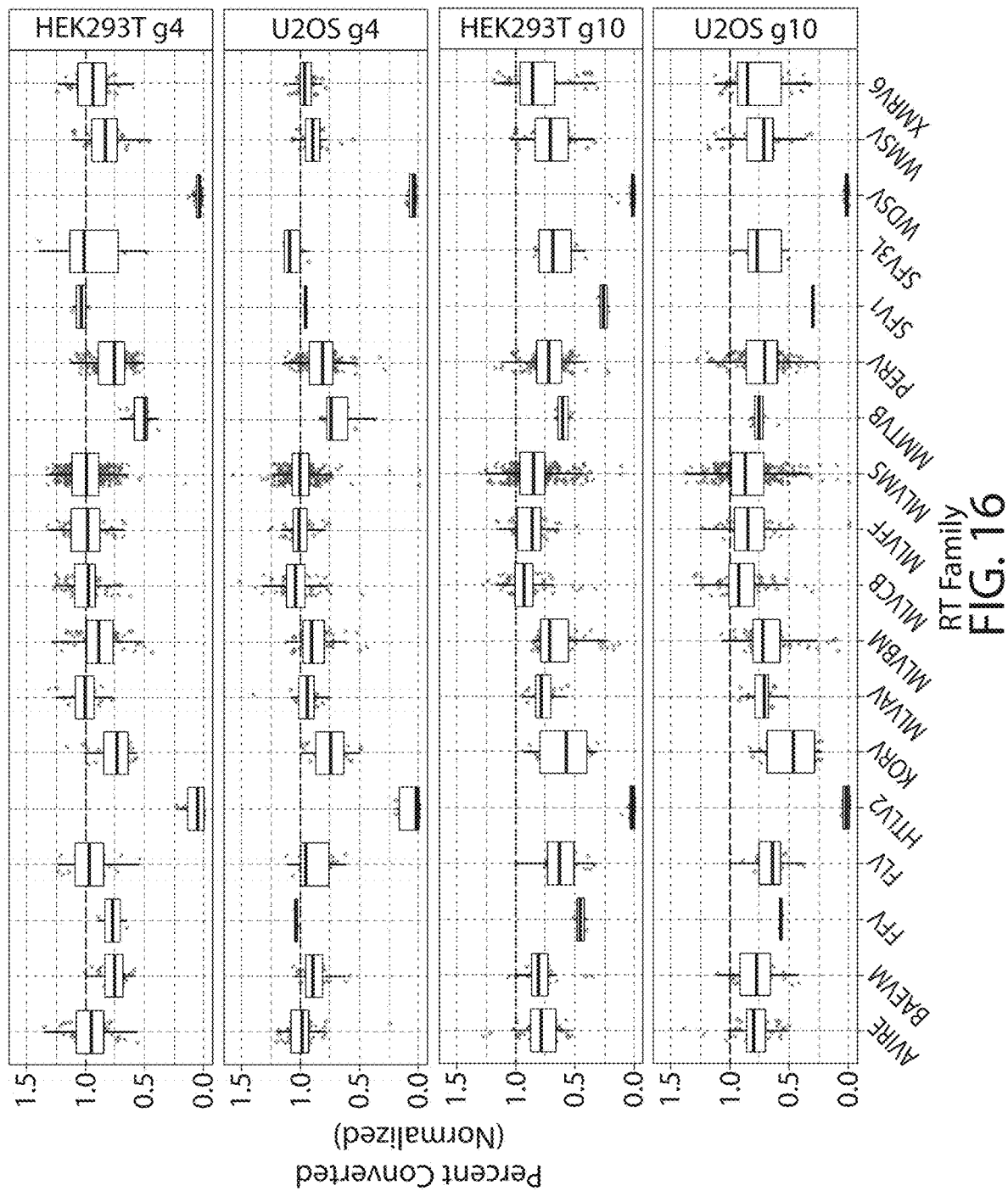
FIG. 16 is a series of graphs showing the percentage of cells undergoing to a successful rewriting event and exhibiting GFP fluorescence after introduction of a gene modifying polypeptide and a plasmid according to the workflow shown in FIG. 15.

The percent converted to GFP for each gene modifying polypeptide and condition, normalized to PL12162 were graphed in a box and whisker plot (FIG. 16). The results confirm that the tested gene modifying polypeptides have editing activity. The results further demonstrate that a number of gene modifying polypeptides exhibit higher editing activity across the four conditions tested than the benchmark gene modifying polypeptide (showing a normalized percent converted greater than 1). Gene modifying polypeptides exhibiting higher editing activity than the benchmark gene modifying polypeptide in at least one condition or in all four conditions are listed in the following Tables, along with controls.

TABLE D11

Gene Modifying Polypeptides Exhibiting Higher Editing Activity Than Benchmark in at Least One Condition
SEQ ID NOs 36
39
43
49
140
193
300
307
309
317
324
480
590
647
715
801
871
873
901
912
958
1006
1012
1017
1018
1038
1049
1171
1197
1198
1225
1371
1372
1373
1374
1376
1377
1380
1382
1384
1390
1401
1404
1405
1406
1618
1672
1857
1861
1864
1865
1870
1883
1943
2087
2089
2091
2097
2099
2101
2106
2115
2120
2300
2301
2303

TABLE D11-continued

Gene Modifying Polypeptides Exhibiting Higher Editing Activity
Than Benchmark in at Least One Condition
SEQ ID NOs 2304
2305
2308
2309
2311
2314
2315
2316
2317
2319
2322
2325
2326
2327
2328
2329
2335
2338
2346
2363
2364
2365
2370
2371
2449
2503
2505
2506
2507
2510
2511
2514
2515
2518
2519
2525
2526
2527
2528
2534
2542
2610
2611
2614
2615
2619
2623
2624
2633
2636
2641
2644
2647
2648
2653
2677
2688
2692
2711
2712
2713
2734
2776
2780
2781
2782
2784
2788
2790
2793
2794
2795
2798
2803
2804
2809

TABLE D11-continued

Gene Modifying Polypeptides Exhibiting Higher Editing Activity
Than Benchmark in at Least One Condition
SEQ ID NOs 2812
2817
2831
2839
2845
2849
2852
2855
2860
2863
2868
2869
2872
2874
2877
2878
2879
2883
2894
2943
2950
3036
3042
3042
3044
3045
3047
3055
3056
3057
3061
3062
3063
3064
3080
3081
3084
3086
3093
3094
7735

TABLE D12

Gene Modifying Polypeptides Exhibiting Higher Editing Activity
Than Benchmark in All Conditions
SEQ ID NOs 1018
1038
2309
2315
2325
2338
2611
2868
3084
7735

TABLE D13

| | Control sequences | |
|---|---|---|
| Normalization Control | Positive Controls | Negative Controls |

| | | |
|---|---|---|
| 2892 | 2181 | MPAAKRVKLDGGDKKYSIGLDIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARLSKSRRLENL
IAQLPGEKKNGLFGNLIALSLGLTPNFKSNFDLAEDAKLQLSKDTYDDDLDNLLAQIGD
QYADLFLAAKNLSDAILLSDILRVNTEITKAPLSASMIKRYDEHHQDLTLLKALVRQQL
PEKYKEIFFDQSKNGYAGYIDGGASQEEFYKFIKPILEKMDGTEELLVKLNREDLLRKQ
RTFDNGSIPHQIHLGELHAILRRQEDFYPFLKDNREKIEKILTFRIPYYVGPLARGNSR
FAWMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFDSVE
ISGVEDRFNASLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDGFANRNFMQLI
HDDSLTFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKARGKSDNVPSEE
VVKKMKNYWRQLLNAKLITQRKFDNLTKAERGGLSELDKAGFIKRQLVETRQITKHVAQ
ILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSVKELLGITIM
ERSSFEKNPIDFLEAKGYKEVKKDLIIKLPKYSLFELENGRKRMLASAGELQKGNELAL
PSKYVNFLYLASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYTSTKEVLDAT
LIHQSITGLYETRIDLSQLGGDGGGSGGSGGSGGSGGSGGSCQTKNTLNIDEYLLQFP
DQLWASLPTDIGRMLVPPITIKIKDNASLPSIRQYPLPKDKTEGLRPLISSLENQGILI
KCHSPCNTPIFPIKKAGRDEYRMIHDLRAINNIVAPLTAVVASPTTVLSNLAPSLHWFT
VIDLSNAFFSVPIHKDSQYLFAFTFEGHQYTWTVLPQGFIHSPTLFPSQALYQSLHKIKF
KISSEICIYMDDVLIASKDRDTNLKDTAVMLQHLASEGHKVSKKKLQLCQQEVVYLGQL
LTPEGRKILPDRKVTVSQFQQPTTIRQIRAFLGLVGYCRHWIPEFSIHSKFLEKQLKKD
TAEPFQLDDQQVEAFNKLKHAITTAPVLVVPDPAKPFQLYTSHSEHASIAVLTQKHAGR
TRPIAFLSSKFDAIESGLPPCLKACASIHRSLTQADSFILGAPLIIYTTHAICTLLQRD
RSQLVTASRFSKWEADLLRPELTFVACSAVSPAHLYMQSCENNIPPHDCVLLTHTISRP
RPDLSDLPIPDPDMTLFSDGSYTTGRGGAAVVMHRPVTDDFIIIHQQPGGASAQTAELL
ALAAACHLATDKTVNIYTDSRYAYGVVHDFGHLWMHRGFVTSAGTPIKNHKEIEYLLKQ
IMKPKQVSVIKIEAHTKGVSMEVRGNAAADEAAKNAVFLVQRAGKRTADGSEFEKRTAD
GSEFESPKKKAKVE (SEQ ID NO: 15466) |
| | 3143 | MPAAKRVKLDGGDKKYSIGLDIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARLSKSRRLENL
IAQLPGEKKNGLFGNLIALSLGLTPNFKSNFDLAEDAKLQLSKDTYDDDLDNLLAQIGD
QYADLFLAAKNLSDAILLSDILRVNTEITKAPLSASMIKRYDEHHQDLTLLKALVRQQL
PEKYKEIFFDQSKNGYAGYIDGGASQEEFYKFIKPILEKMDGTEELLVKLNREDLLRKQ
RTFDNGSIPHQIHLGELHAILRRQEDFYPFLKDNREKIEKILTFRIPYYVGPLARGNSR
FAWMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFDSVE
ISGVEDRFNASLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDGFANRNFMQLI
HDDSLTFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKARGKSDNVPSEE
VVKKMKNYWRQLLNAKLITQRKFDNLTKAERGGLSELDKAGFIKRQLVETRQITKHVAQ
ILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSVKELLGITIM
ERSSFEKNPIDFLEAKGYKEVKKDLIIKLPKYSLFELENGRKRMLASAGELQKGNELAL
PSKYVNFLYLASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYTSTKEVLDAT
LIHQSITGLYETRIDLSQLGGDGGGSSGGSEAAAKGGSCQTKNTLNIDEYLLQPFDQLW
ASLPTDIGRMLVPPITIKIKDNASLPSIRQYPLPKDKTEGLRPLISSLENQGILIKCHS
PCNTPIFPIKKAGRDEYRMIHDLRAINNIVAPLTAVVASPTTVLSNLAPSLHWFTVIDL
SNAFFSVPIHKDSQYLFAFTFEGHQYTWTVLPQGFIHSPTLFNQALYQSLHKIKFKISS
EICIYMDDVLIASKDRDTNLKDTAVMLQHLASEGHKVSKKKLQLCQQEVVYLGQLLTPE
GRKILPDRKVTVSQFQQPTTIRQIRAFLGKVGYCRHFIPEFSIHSKFLEKQLKPDTAEP
FQLDDQQVEAFNKLKHAITTAPVLVVPDPAKPFQLYTSHSEHASIAVLTQKHAGRTRPI
AFLSSKFDAIESGLPPCLKACASIHRSLTQADSFILGAPLIIYTTHAICTLLQRDRSQL
VTASRFSKWEADLLRPELTFVACSAVSPAHLYMQSCENNIPPHDCVLLTHTISRPRPDL
SDLPIPDPDMTLFSDGSYTTGRGGAAVVMHRPVTDDFIIIHQQPGGASAQTAELLALAA
ACHLATDKTVNIYTDSRYAYGVVHDFGHLWMHRGFVTSAGTPIKNHKEIEYLLKQIMKP
KQVSVIKIEAHTKGVSMEVRGNAAADEAAKNAVFLVQRAGKRTADGSEFEKRTADGSEF
ESPKKKAKVE (SEQ ID NO: 15467) |

TABLE D13-continued

Control sequences

| Normalization Control | Positive Controls | Negative Controls |
|---|---|---|

MPAAKRVKLDGGDKKYSIGLDIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARLSKSRRLENL
IAQLPGEKKNGLFGNLIALSLGLTPNFKSNFDLAEDAKLQLSKDTYDDDLDNLLAQIGD
QYADLFLAAKNLSDAILLSDILRVNTEITKAPLSASMIKRYDEHHQDLTLLKALVRQQL
PEKYKEIFFDQSKNGYAGYIDGGASQEEFYKFIKPILEKMDGTEELLVKLNREDLLRKQ
RTFDNGSIPHQIHLGELHAILRRQEDFYPFLKDNREKIEKILTFRIPYYVGPLARGNSR
FAWMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFDSVE
ISGVEDRFNASLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDGFANRNFMQLI
HDDSLTFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKARGKSDNVPSEE
VVKKMKNYWRQLLNAKLITQRKFDNLTKAERGGLSELDKAGFIKRQLVETRQITKHVAQ
ILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSVKELLGITIM
ERSSFEKNPIDFLEAKGYKEVKKDLIIKLPKYSLFELENGRKRMLASAGELQKGNELAL
PSKYVNFLYLASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYTSTKEVLDAT
LIHQSITGLYETRIDLSQLGGDGGGSSGGSPAPGGHLPPPPQVDQFPLNLPERLQALND
LVSKALEAGHIEPYSGPGNNPVFPVKKPNGKWRFIHDLRATNAITTTLTSPSPGPPDLT
SLPTALPHLQTIDLTDAFFQIPLPKQYQPYFAFTIPQPCNYGPGTRYAWTVLPQGFKNS
PTLFEQQLAAVLNPMRKMFPTSTIVQYMDDILLASPTNEELQQLSQLTLQALTTHGLPI
SQEKTQQTPGQIRFLGQVISPNHITYESTPTIPIKSQWTLTELQVILGEIQWVSKGTPI
LRKHLQSLYSALHGYRDPRACITLTPQQLHALHAIQQALQHNCRGRLNPALPLLGLISL
STSGTTSVIFQPKQNWPLAWLHTPHPPTSLCPWGHLLACTILTLDKYTLQHYGQLCQSF
HHNMSKQALCDFLRNSPHPSVGILIHHMGRFHNLGSQPSGPWKTLLHLPTLLQEPRLLR
PIFTLSPVVLDTAPCLFSDGSPQKAAYVLWDQTILQQDITPLPSHETHSAQKGELLALI
CGLRAAKPWPSLNIFLDSKYLIKYLHSLAIGAFLGTSAHQTLQAALPPLLQGKTIYLHH
VRSHTNLPDPISTFNEYTDSLILAPLVPLAGKRTADGSEFEKRTADGSEFESPKKKAKV
E (SEQ ID NO: 15468)

MPAAKRVKLDGGDKKYSIGLDIGTNSVGWAVITDEYKVPSKKFKVLGNTDRHSIKKNLI
GALLFDSGETAEATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARLSKSRRLENL
IAQLPGEKKNGLFGNLIALSLGLTPNFKSNFDLAEDAKLQLSKDTYDDDLDNLLAQIGD
QYADLFLAAKNLSDAILLSDILRVNTEITKAPLSASMIKRYDEHHQDLTLLKALVRQQL
PEKYKEIFFDQSKNGYAGYIDGGASQEEFYKFIKPILEKMDGTEELLVKLNREDLLRKQ
RTFDNGSIPHQIHLGELHAILRRQEDFYPFLKDNREKIEKILTFRIPYYVGPLARGNSR
FAWMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFDSVE
ISGVEDRFNASLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDGFANRNFMQLI
HDDSLTFKEDIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQLQNEKLYLYY
LQNGRDMYVDQELDINRLSDYDVDHIVPQSFLKDDSIDNKVLTRSDKARGKSDNVPSEE
VVKKMKNYWRQLLNAKLITQRKFDNLTKAERGGLSELDKAGFIKRQLVETRQITKHVAQ
ILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSVKELLGITIM
ERSSFEKNPIDFLEAKGYKEVKKDLIIKLPKYSLFELENGRKRMLASAGELQKGNELAL
PSKYVNFLYLASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYTSTKEVLDAT
LIHQSITGLYETRIDLSQLGGDGGGSSGGSPAPGGSCQTKNTLNIDEYLLQFPDQLWAS
LPTDIGRMLVPPITIKIKDNASLPSIRQYPLPKDKTEGLRPLISSLENQGILIKCHSPC
NTPIFPIKKAGRDEYRMIHDLRAINNIVAPLTAVVASPTTVLSNLAPSLHWFTVIDLSN
AFFSVPIHKDSQYLFAFTFEGHQYTWTVLPQGFIHSPTLFNQALYQSLHKIKFKISSEI
CIYMDDVLIASKDRDTNLKDTAVMLQHLASEGHKVSKKKLQLCQQEVVYLGQLLTPEGR
KILPDRKVTVSQFQQPTTIRQIRAFLGKVGYCRHFIPEFSIHSKFLEKQLKPDTAEPFQ
LDDQQVEAFNKLKHAITTAPVLVVPDPAKPFQLYTSHSEHASIAVLTQKHAGRTRPIAF
LSSKFDAIESGLPPCLKACASIHRSLTQADSFILGAPLIIYTTHAICTLLQRDRSQLVT
ASRFSKWEADLLRPELTFVACSAVSPAHLYMQSCENNIPPHDCVLLTHTISRPRPDLSD
LPIPDPDMTLFSDGSYTTGRGGAAVVMHRPVTDDFIIIHQQPGGASAQTAELLALAAAC
HLATDKTVNIYTDSRYAYGVVHDFGHLWMRGFVTSAGTPIKNHKEIEYLLKQIMKPKQ
VSVIKIEAHTKGVSMEVRGNAAADEAAKNAVFLVQRAGKRTADGSEFEKRTADGSEFES
PKKKAKVE (SEQ ID NO: 15469)

TABLE D13-continued

Control sequences

| Normalization Control | Positive Controls | Negative Controls |
|---|---|---|
| | | MPAAKRVKLDGGDKKYSIGLDIGTNSVGWAVITDEYKVPSKKFKVLGNTDRHSIKKNLI<br>GALLFDSGETAEATRLKRTARRRYTRRKNRICYLQEIFSNEMAKVDDSFFHRLEESFLV<br>EEDKKHERHPIFGNIVDEVAYHEKYPTIYHLRKKLVDSTDKADLRLIYLALAHMIKFRG<br>HFLIEGDLNPDNSDVDKLFIQLVQTYNQLFEENPINASGVDAKAILSARLSKSRRLENL<br>IAQLPGEKKNGLFGNLIALSLGLTPNFKSNFDLAEDAKLQLSKDTYDDDLDNLLAQIGD<br>QYADLFLAAKNLSDAILLSDILRVNTEITKAPLSASMIKRYDEHHQDLTLLKALVRQQL<br>PEKYKEIFFDQSKNGYAGYIDGGASQEEFYKFIKPILEKMDGTEELLVKLNREDLLRKQ<br>RTFDNGSIPHQIHLGELHAILRRQEDFYPFLKDNREKIEKILTFRIPYYVGPLARGNSR<br>FAWMTRKSEETITPWNFEEVVDKGASAQSFIERMTNFDKNLPNEKVLPKHSLLYEYFTV<br>YNELTKVKYVTEGMRKPAFLSGEQKKAIVDLLFKTNRKVTVKQLKEDYFKKIECFDSVE<br>ISGVEDRFNASLGTYHDLLKIIKDKDFLDNEENEDILEDIVLTLTLFEDREMIEERLKT<br>YAHLFDDKVMKQLKRRRYTGWGRLSRKLINGIRDKQSGKTILDFLKSDGFANRNFMQLI<br>HDDSLTFKEDIQKAQVSGQGDSLHEHIANLAGSPAIKKGILQTVKVVDELVKVMGRHKP<br>ENIVIEMARENQTTQKGQKNSRERMKRIEEGIKELGSQILKEHPVENTQLQNEKLYLYY<br>LQNGRDMYVDQELDINRLSDYDVDHIVPQSFLKDDSIDNKVLTRSDKARGKSDNVPSEE<br>VVKKMKNYWRQLLNAKLITQRKFDNLTKAERGGLSELDKAGFIKRQLVETRQITKHVAQ<br>ILDSRMNTKYDENDKLIREVKVITLKSKLVSDFRKDFQFYKVREINNYHHAHDAYLNAV<br>VGTALIKKYPKLESEFVYGDYKVYDVRKMIAKSEQEIGKATAKYFFYSNIMNFFKTEIT<br>LANGEIRKRPLIETNGETGEIVWDKGRDFATVRKVLSMPQVNIVKKTEVQTGGFSKESI<br>LPKRNSDKLIARKKDWDPKKYGGFDSPTVAYSVLVVAKVEKGKSKKLKSVKELLGITIM<br>ERSSFEKNPIDFLEAKGYKEVKKDLIIKLPKYSLFELENGRKRMLASAGELQKGNELAL<br>PSKYVNFLYLASHYEKLKGSPEDNEQKQLFVEQHKHYLDEIIEQISEFSKRVILADANL<br>DKVLSAYNKHRDKPIREQAENIIHLFTLTNLGAPAAFKYFDTTIDRKRYTSTKEVLDAT<br>LIHQSITGLYETRIDLSQLGGDGGGGGPAPGSSGGHLPPPPQVDQFPLNLPERLQALND<br>LVSKALEAGHIEPYSGPGNNPVFPVKKPNGKWRFIHDLRATNAITTTLTSPSPGPPDLT<br>SLPTALPHLQTIDLTDAFFQIPLPKQYQPYFAFTIPQPCNYGPGTRYAWTVLPQGFKNS<br>PTLFQQQLAAVLNPMRKMFPTSTIVQYMDDILLASPTNEELQQLSQLTLQALTTHGLPI<br>SQEKTQQTPGQIRFLGQVISPNHITYESTPTIPIKSQWTLTELQVILGEIQWVSKGTPI<br>LRKHLQSLYSALHPYRDPRACITLTPQQLHALHAIQQALQHNCRGRLNPALPLLGLISL<br>STSGTTSVIFQPKQNWPLAWLHTPHPPTSLCPWGHLLACTILTLDKYTLQHYGQLCQSF<br>HHNMSKQALCDFLRNSPHPSVGILIHHMGRFHNLGSQPSGPWKTLLHLPTLLQEPRLLR<br>PIFTLSPVVLDTAPCLFSDGSPQKAAYVLWDQTILQQDITPLPSHETHSAQKGELLALI<br>CGLRAAKPWPSLNIFLDSKYLIKYLHSLAIGAFLGTSAHQTLQAALPPLLQGKTIYLHH<br>VRSHTNLPDPISTFNEYTDSLILAPLVPLAGKRTADGSEFEKRTADGSEFESPKKKAKV<br>E (SEQ ID NO: 15470) |

Figure 17:
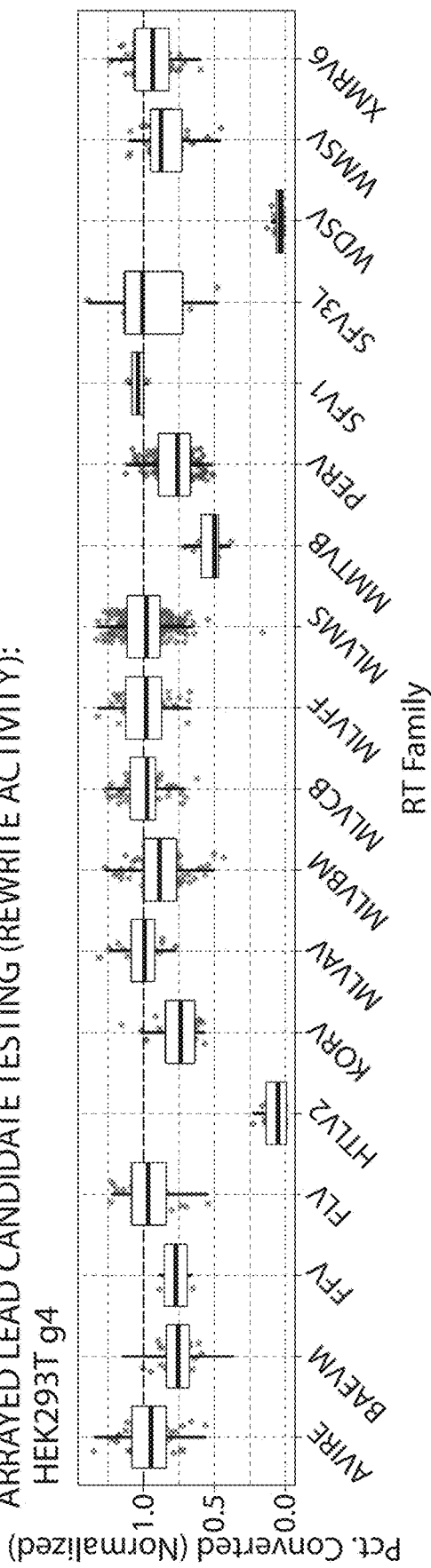
FIG. 17 is a series of graphs showing the result of testing of arrayed lead candidates compared to the results from screening pooled RT candidates.
Figure 17:
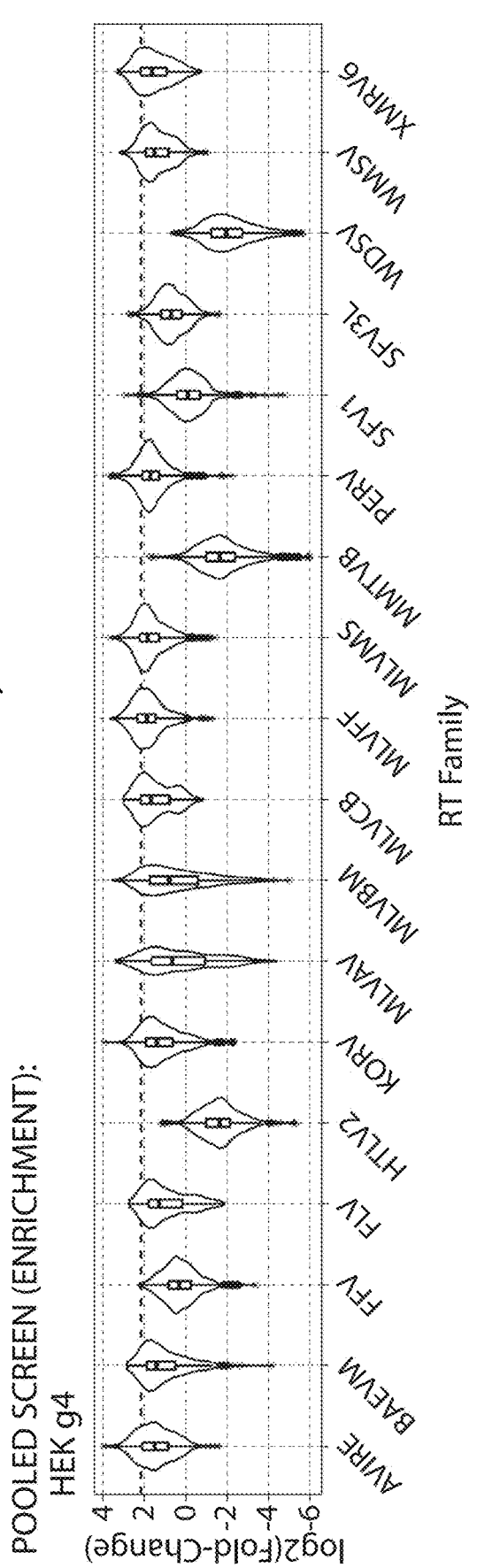

The data from each candidate tested within an RT family were grouped and compared to the data for the pooled RT families tested in the preceding Examples to verify that the trends seen in the pooled experiments were replicated when the candidates were tested individually (FIG. 17). The results confirmed that the performance of exemplary gene modifying polypeptides when tested individually recapitulated the trends observed in the pooled experiments.

It should be understood that for all numerical bounds describing some parameter in this application, such as "about," "at least," "less than," and "more than," the description also necessarily encompasses any range bounded by the recited values. Accordingly, for example, the description "at least 1, 2, 3, 4, or 5" also describes, inter alia, the ranges 1-2, 1-3, 1-4, 1-5, 2-3, 2-4, 2-5, 3-4, 3-5, and 4-5, et cetera.

For all patents, applications, or other reference cited herein, such as non-patent literature and reference sequence information, it should be understood that they are incorporated by reference in their entirety for all purposes as well as for the proposition that is recited. Where any conflict exists between a document incorporated by reference and the present application, this application will control. All information associated with reference gene sequences disclosed in this application, such as GeneIDs or accession numbers (typically referencing NCBI accession numbers), including, for example, genomic loci, genomic sequences, functional annotations, allelic variants, and reference mRNA (including, e.g., exon boundaries or response elements) and protein sequences (such as conserved domain structures), as well as chemical references (e.g., PubChem compound, PubChem substance, or PubChem Bioassay entries, including the annotations therein, such as structures and assays, et cetera), are hereby incorporated by reference in their entirety.

Headings used in this application are for convenience only and do not affect the interpretation of this application.

LENGTHY TABLES

The patent contains a lengthy table section. A copy of the table is available in electronic form from the USPTO web site (https://seqdata.uspto.gov/?pageRequest=docDetail&DocID=US12024728B2). An electronic copy of the table will also be available from the USPTO upon request and payment of the fee set forth in 37 CFR 1.19(b)(3).

SEQUENCE LISTING (15471 sequences)

SEQ ID NO: 1 - protein, 2133 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 2 - protein, 2112 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 3 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 4 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 5 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 6 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 7 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 8 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 9 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 10 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 11 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 12 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 13 - protein, 2103 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 14 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 15 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 16 - protein, 2098 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFDEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGTIGYCRLWIPGFAELAQPLYAATRGGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGLLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 17 - protein, 1998 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQLAGKRTADGSEFEKRTADGSEFESPKKKAKVE

SEQ ID NO: 18 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 19 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 20 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGWVQEISDSRPMLHIYLNGRRFLGLLNTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAPPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAGKRTADGSEFEKRTADGSEFESPKKKAKVE

SEQ ID NO: 21 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 22 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 23 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 24 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 25 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPPAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 26 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 27 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 28 - protein, 2116 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 29 - protein, 2113 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 30 - protein, 2111 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 31 - protein, 2114 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNPDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTAAGKRTADGSEFEKRTADGSEFESPKKKAKVE

SEQ ID NO: 32 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTAGKRTADGSEFEKRTADGSEFESPKKKAKVE

SEQ ID NO: 33 - protein, 2008 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAPPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKPDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTAGKRTADGSEFEKRTADGSEFESPKKKAKVE

SEQ ID NO: 34 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 35 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 36 - protein, 2123 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 37 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 38 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 39 - protein, 2102 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 40 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 41 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 42 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 43 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 44 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 45 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 46 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 47 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 48 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 49 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 50 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 51 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 52 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 53 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 54 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 55 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 56 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 57 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 58 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 59 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 60 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 61 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 62 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 63 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 64 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 65 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 66 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 67 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 68 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 69 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 70 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 71 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 72 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 73 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 74 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 75 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 76 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 77 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 78 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 79 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 80 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 81 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 82 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 83 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 84 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 85 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 86 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 87 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 88 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 89 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 90 - protein, 2093 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 91 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 92 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 93 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 94 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 95 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 96 - protein, 2104 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 97 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 98 - protein, 2125 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 99 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 100 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 101 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 102 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 103 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 104 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 105 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 106 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 107 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 108 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 109 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 110 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 111 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 112 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 113 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 114 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 115 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 116 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 117 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 118 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 119 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 120 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 121 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 122 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 123 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 124 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 125 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 126 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 127 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 128 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 129 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 130 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 131 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 132 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 133 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 134 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 135 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 136 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 137 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 138 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 139 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 140 - protein, 2112 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 141 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 142 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 143 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 144 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 145 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 146 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 147 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 148 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 149 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 150 - protein, 2104 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 151 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 152 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 153 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 154 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 155 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 156 - protein, 2125 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 157 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 158 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 159 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 160 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 161 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 162 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 163 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 164 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 165 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 166 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 167 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 168 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 169 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 170 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 171 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 172 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 173 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 174 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 175 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 176 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 177 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 178 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 179 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 180 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 181 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 182 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 183 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 184 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 185 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 186 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 187 - protein, 1999 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 188 - protein, 2015 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 189 - protein, 1996 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFNRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 190 - protein, 2123 aa, synthetic construct; identical to SEQ ID NO: 36

SEQ ID NO: 191 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 192 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 193 - protein, 2107 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 194 - protein, 2090 aa, synthetic construct; identical to SEQ ID NO: 54

SEQ ID NO: 195 - protein, 2088 aa, synthetic construct; identical to SEQ ID NO: 35

SEQ ID NO: 196 - protein, 2093 aa, synthetic construct; identical to SEQ ID NO: 90

SEQ ID NO: 197 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 198 - protein, 2086 aa, synthetic construct; identical to SEQ ID NO: 58

SEQ ID NO: 199 - protein, 2088 aa, synthetic construct; identical to SEQ ID NO: 40

SEQ ID NO: 200 - protein, 2088 aa, synthetic construct; identical to SEQ ID NO: 63

SEQ ID NO: 201 - protein, 2089 aa, synthetic construct; identical to SEQ ID NO: 74

SEQ ID NO: 202 - protein, 2092 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 203 - protein, 2083 aa, synthetic construct; identical to SEQ ID NO: 76

SEQ ID NO: 204 - protein, 2088 aa, synthetic construct; identical to SEQ ID NO: 71

SEQ ID NO: 205 - protein, 2086 aa, synthetic construct; identical to SEQ ID NO: 73

SEQ ID NO: 206 - protein, 2085 aa, synthetic construct; identical to SEQ ID NO: 57

SEQ ID NO: 207 - protein, 2086 aa, synthetic construct; identical to SEQ ID NO: 43

SEQ ID NO: 208 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 209 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 210 - protein, 2086 aa, synthetic construct; identical to SEQ ID NO: 89

SEQ ID NO: 211 - protein, 2088 aa, synthetic construct; identical to SEQ ID NO: 42

SEQ ID NO: 212 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 213 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 214 - protein, 2095 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 215 - protein, 2097 aa, synthetic construct; identical to SEQ ID NO: 46

SEQ ID NO: 216 - protein, 2092 aa, synthetic construct; identical to SEQ ID NO: 51

SEQ ID NO: 217 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 218 - protein, 2082 aa, synthetic construct; identical to SEQ ID NO: 70

SEQ ID NO: 219 - protein, 2085 aa, synthetic construct; identical to SEQ ID NO: 48

SEQ ID NO: 220 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 221 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 222 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 223 - protein, 2083 aa, synthetic construct; identical to SEQ ID NO: 47

SEQ ID NO: 224 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 225 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 226 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 227 - protein, 2083 aa, synthetic construct; identical to SEQ ID NO: 78

SEQ ID NO: 228 - protein, 2089 aa, synthetic construct; identical to SEQ ID NO: 41

SEQ ID NO: 229 - protein, 2088 aa, synthetic construct; identical to SEQ ID NO: 65

SEQ ID NO: 230 - protein, 2088 aa, synthetic construct; identical to SEQ ID NO: 80

SEQ ID NO: 231 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 232 - protein, 2102 aa, synthetic construct; identical to SEQ ID NO: 39

SEQ ID NO: 233 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 234 - protein, 2092 aa, synthetic construct; identical to SEQ ID NO: 56

SEQ ID NO: 235 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 236 - protein, 2089 aa, synthetic construct; identical to SEQ ID NO: 67

SEQ ID NO: 237 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 238 - protein, 2092 aa, synthetic construct; identical to SEQ ID NO: 52

SEQ ID NO: 239 - protein, 2088 aa, synthetic construct; identical to SEQ ID NO: 49

SEQ ID NO: 240 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 241 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 242 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 243 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 244 - protein, 2084 aa, synthetic construct; identical to SEQ ID NO: 77

SEQ ID NO: 245 - protein, 2081 aa, synthetic construct; identical to SEQ ID NO: 66

SEQ ID NO: 246 - protein, 2080 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 247 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 248 - protein, 2088 aa, synthetic construct; identical to SEQ ID NO: 94

SEQ ID NO: 249 - protein, 2086 aa, synthetic construct; identical to SEQ ID NO: 60

SEQ ID NO: 250 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 251 - protein, 2086 aa, synthetic construct; identical to SEQ ID NO: 82

SEQ ID NO: 252 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 253 - protein, 2083 aa, synthetic construct; identical to SEQ ID NO: 59

SEQ ID NO: 254 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 255 - protein, 2088 aa, synthetic construct; identical to SEQ ID NO: 86

SEQ ID NO: 256 - protein, 2107 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 257 - protein, 2086 aa, synthetic construct; identical to SEQ ID NO: 64

SEQ ID NO: 258 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 259 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 260 - protein, 2088 aa, synthetic construct; identical to SEQ ID NO: 93

SEQ ID NO: 261 - protein, 2083 aa, synthetic construct; identical to SEQ ID NO: 81

SEQ ID NO: 262 - protein, 2080 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 263 - protein, 2088 aa, synthetic construct; identical to SEQ ID NO: 92

SEQ ID NO: 264 - protein, 2088 aa, synthetic construct; identical to SEQ ID NO: 53

SEQ ID NO: 265 - protein, 2083 aa, synthetic construct; identical to SEQ ID NO: 79

SEQ ID NO: 266 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 267 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 268 - protein, 2086 aa, synthetic construct; identical to SEQ ID NO: 38

SEQ ID NO: 269 - protein, 2080 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 270 - protein, 2086 aa, synthetic construct; identical to SEQ ID NO: 69

SEQ ID NO: 271 - protein, 2083 aa, synthetic construct; identical to SEQ ID NO: 88

SEQ ID NO: 272 - protein, 2086 aa, synthetic construct; identical to SEQ ID NO: 85

SEQ ID NO: 273 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 274 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 275 - protein, 2086 aa, synthetic construct; identical to SEQ ID NO: 91

SEQ ID NO: 276 - protein, 2086 aa, synthetic construct; identical to SEQ ID NO: 95

SEQ ID NO: 277 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGKAGFCRLFIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLPAGKRTADGSEFEKRTADGSEFESPKKKAKVE

SEQ ID NO: 278 - protein, 2090 aa, synthetic construct; identical to SEQ ID NO: 112

SEQ ID NO: 279 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 280 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 281 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 282 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 283 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 284 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 285 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 286 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 287 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 288 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 289 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 290 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 291 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 292 - protein, 2097 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 293 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 294 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 295 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 296 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 297 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 298 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 299 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 300 - protein, 2125 aa, synthetic construct; identical to SEQ ID NO: 156

SEQ ID NO: 301 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 302 - protein, 2090 aa, synthetic construct; identical to SEQ ID NO: 164

SEQ ID NO: 303 - protein, 2112 aa, synthetic construct; identical to SEQ ID NO: 140

SEQ ID NO: 304 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 305 - protein, 2090 aa, synthetic construct; identical to SEQ ID NO: 127

SEQ ID NO: 306 - protein, 2087 aa, synthetic construct; identical to SEQ ID NO: 126

SEQ ID NO: 307 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 308 - protein, 2084 aa, synthetic construct; identical to SEQ ID NO: 151

SEQ ID NO: 309 - protein, 2092 aa, synthetic construct; identical to SEQ ID NO: 157

SEQ ID NO: 310 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 311 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 312 - protein, 2090 aa, synthetic construct; identical to SEQ ID NO: 116

SEQ ID NO: 313 - protein, 2109 aa, synthetic construct; identical to SEQ ID NO: 117

SEQ ID NO: 314 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 315 - protein, 2082 aa, synthetic construct; identical to SEQ ID NO: 120

SEQ ID NO: 316 - protein, 2097 aa, synthetic construct; identical to SEQ ID NO: 142

SEQ ID NO: 317 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 318 - protein, 2090 aa, synthetic construct; identical to SEQ ID NO: 121

SEQ ID NO: 319 - protein, 2090 aa, synthetic construct; identical to SEQ ID NO: 124

SEQ ID NO: 320 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 321 - protein, 2090 aa, synthetic construct; identical to SEQ ID NO: 138

SEQ ID NO: 322 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 323 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 324 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 325 - protein, 2087 aa, synthetic construct; identical to SEQ ID NO: 128

SEQ ID NO: 326 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 327 - protein, 2090 aa, synthetic construct; identical to SEQ ID NO: 132

SEQ ID NO: 328 - protein, 2095 aa, synthetic construct; identical to SEQ ID NO: 122

SEQ ID NO: 329 - protein, 2085 aa, synthetic construct; identical to SEQ ID NO: 143

SEQ ID NO: 330 - protein, 2090 aa, synthetic construct; identical to SEQ ID NO: 160

SEQ ID NO: 331 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 332 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 333 - protein, 2083 aa, synthetic construct; identical to SEQ ID NO: 149

SEQ ID NO: 334 - protein, 2090 aa, synthetic construct; identical to SEQ ID NO: 146

SEQ ID NO: 335 - protein, 2087 aa, synthetic construct; identical to SEQ ID NO: 158

SEQ ID NO: 336 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 337 - protein, 2104 aa, synthetic construct; identical to SEQ ID NO: 150

SEQ ID NO: 338 - protein, 2088 aa, synthetic construct; identical to SEQ ID NO: 169

SEQ ID NO: 339 - protein, 2088 aa, synthetic construct; identical to SEQ ID NO: 162

SEQ ID NO: 340 - protein, 2088 aa, synthetic construct; identical to SEQ ID NO: 173

SEQ ID NO: 341 - protein, 2090 aa, synthetic construct; identical to SEQ ID NO: 141

SEQ ID NO: 342 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 343 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 344 - protein, 2088 aa, synthetic construct; identical to SEQ ID NO: 131

SEQ ID NO: 345 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 346 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 347 - protein, 2082 aa, synthetic construct; identical to SEQ ID NO: 177

SEQ ID NO: 348 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 349 - protein, 2090 aa, synthetic construct; identical to SEQ ID NO: 136

SEQ ID NO: 350 - protein, 2090 aa, synthetic construct; identical to SEQ ID NO: 115

SEQ ID NO: 351 - protein, 2099 aa, synthetic construct; identical to SEQ ID NO: 137

SEQ ID NO: 352 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 353 - protein, 2085 aa, synthetic construct; identical to SEQ ID NO: 183

SEQ ID NO: 354 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 355 - protein, 2099 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 356 - protein, 2085 aa, synthetic construct; identical to SEQ ID NO: 125

SEQ ID NO: 357 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 358 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 359 - protein, 2088 aa, synthetic construct; identical to SEQ ID NO: 175

SEQ ID NO: 360 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 361 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 362 - protein, 2087 aa, synthetic construct; identical to SEQ ID NO: 114

SEQ ID NO: 363 - protein, 2090 aa, synthetic construct; identical to SEQ ID NO: 139

SEQ ID NO: 364 - protein, 2088 aa, synthetic construct; identical to SEQ ID NO: 181

SEQ ID NO: 365 - protein, 2090 aa, synthetic construct; identical to SEQ ID NO: 133

SEQ ID NO: 366 - protein, 2084 aa, synthetic construct; identical to SEQ ID NO: 163

SEQ ID NO: 367 - protein, 2084 aa, synthetic construct; identical to SEQ ID NO: 166

SEQ ID NO: 368 - protein, 2090 aa, synthetic construct; identical to SEQ ID NO: 170

SEQ ID NO: 369 - protein, 2085 aa, synthetic construct; identical to SEQ ID NO: 165

SEQ ID NO: 370 - protein, 2091 aa, synthetic construct; identical to SEQ ID NO: 153

SEQ ID NO: 371 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 372 - protein, 2090 aa, synthetic construct; identical to SEQ ID NO: 172

SEQ ID NO: 373 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 374 - protein, 2094 aa, synthetic construct; identical to SEQ ID NO: 118

SEQ ID NO: 375 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 376 - protein, 2090 aa, synthetic construct; identical to SEQ ID NO: 154

SEQ ID NO: 377 - protein, 2091 aa, synthetic construct; identical to SEQ ID NO: 145

SEQ ID NO: 378 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 379 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 380 - protein, 2087 aa, synthetic construct; identical to SEQ ID NO: 185

SEQ ID NO: 381 - protein, 2086 aa, synthetic construct; identical to SEQ ID NO: 152

SEQ ID NO: 382 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 383 - protein, 2085 aa, synthetic construct; identical to SEQ ID NO: 178

SEQ ID NO: 384 - protein, 2088 aa, synthetic construct; identical to SEQ ID NO: 144

SEQ ID NO: 385 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 386 - protein, 2085 aa, synthetic construct; identical to SEQ ID NO: 123

SEQ ID NO: 387 - protein, 2088 aa, synthetic construct; identical to SEQ ID NO: 155

SEQ ID NO: 388 - protein, 2088 aa, synthetic construct; identical to SEQ ID NO: 134

SEQ ID NO: 389 - protein, 2088 aa, synthetic construct; identical to SEQ ID NO: 171

SEQ ID NO: 390 - protein, 2090 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 391 - protein, 2094 aa, synthetic construct; identical to SEQ ID NO: 159

SEQ ID NO: 392 - protein, 2084 aa, synthetic construct; identical to SEQ ID NO: 147

SEQ ID NO: 393 - protein, 2085 aa, synthetic construct; identical to SEQ ID NO: 174

SEQ ID NO: 394 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 395 - protein, 2088 aa, synthetic construct; identical to SEQ ID NO: 180

SEQ ID NO: 396 - protein, 2097 aa, synthetic construct; identical to SEQ ID NO: 113

SEQ ID NO: 397 - protein, 2085 aa, synthetic construct; identical to SEQ ID NO: 184

SEQ ID NO: 398 - protein, 2090 aa, synthetic construct; identical to SEQ ID NO: 119

SEQ ID NO: 399 - protein, 2089 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 400 - protein, 2088 aa, synthetic construct; identical to SEQ ID NO: 129

SEQ ID NO: 401 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 402 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSPAPGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 403 - protein, 2088 aa, synthetic construct; identical to SEQ ID NO: 130

SEQ ID NO: 404 - protein, 2094 aa, synthetic construct; identical to SEQ ID NO: 161

SEQ ID NO: 405 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFNEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKPKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGWLTSAGREIKNKEEILSLLEALHLPKRLAIIHCPGHQKAKDPISRGNQMADRVAKQAAQGVNLLAGKRTADGSEFEKRTADGSEFESPKKKAKVE

SEQ ID NO: 406 - protein, 2088 aa, synthetic construct; identical to SEQ ID NO: 182

SEQ ID NO: 407 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 408 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 409 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 410 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 411 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 412 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 413 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 414 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 415 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 416 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 417 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 418 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 419 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 420 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 421 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 422 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 423 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 424 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 425 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 426 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 427 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 428 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 429 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 430 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 431 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 432 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 433 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 434 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 435 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 436 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 437 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 438 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 439 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 440 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 441 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 442 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 443 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 444 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 445 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 446 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 447 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 448 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 449 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 450 - protein, 2094 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 451 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 452 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 453 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 454 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 455 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 456 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 457 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 458 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 459 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 460 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 461 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 462 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 463 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 464 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 465 - protein, 2170 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 466 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 467 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 468 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 469 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 470 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 471 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 472 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 473 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 474 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 475 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 476 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 477 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 478 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 479 - protein, 2170 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 480 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 481 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 482 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 483 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 484 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 485 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 486 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 487 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 488 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSGGMDPLQLLQPLEAEIKGTKLKAHWNSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFNADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGKLNFARNFIPNYSELVKPLYTIVAPANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHAGKRTADGSEFEKRTADGSEFESPKKKAKVE

SEQ ID NO: 489 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 490 - protein, 2190 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 491 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 492 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 493 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 494 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 495 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 496 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 497 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 498 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 499 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 500 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 501 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 502 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 503 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 504 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 505 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 506 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 507 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 508 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 509 - protein, 2183 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 510 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 511 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 512 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 513 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 514 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 515 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 516 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 517 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 518 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 519 - protein, 2175 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 520 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 521 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 522 - protein, 2010 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPPTHPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 523 - protein, 1995 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAPPTHPPHIICLDLKDAFFQIPVEDRFRFYLSFTLPSPGGLQPHRRFAWRVLPQGFINSPALFQRALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTWVLGAWLQPDPVPSYALLYKSLLRHPAIVVGHVRSHSSASHPIASLNNYVDQLAGKRTADGSEFEKRTADGSEFESPKKKAKVE

SEQ ID NO: 524 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 525 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 526 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 527 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 528 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 529 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 530 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 531 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 532 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 533 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFTADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATANGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 534 - protein, 2079 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 535 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 536 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 537 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 538 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 539 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 540 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 541 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 542 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 543 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 544 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 545 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 546 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 547 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 548 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 549 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 550 - protein, 2106 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 551 - protein, 2079 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 552 - protein, 2079 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 553 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 554 - protein, 2081 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 555 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 556 - protein, 2096 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 557 - protein, 2086 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 558 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 559 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 560 - protein, 2083 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 561 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 562 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 563 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 564 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 565 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 566 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 567 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 568 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 569 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 570 - protein, 2101 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 571 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 572 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 573 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 574 - protein, 2091 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 575 - protein, 2082 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 576 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 577 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 578 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 579 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 580 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 581 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 582 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 583 - protein, 2087 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 584 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 585 - protein, 2109 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 586 - protein, 2088 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 587 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGSGGGGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 588 - protein, 2084 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 589 - protein, 2085 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 590 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 591 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 592 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 593 - protein, 2190 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 594 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 595 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 596 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 597 - protein, 2175 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 598 - protein, 2175 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 599 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 600 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 601 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 602 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 603 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 604 - protein, 2183 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGSGGSGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 605 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 606 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGSGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 607 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 608 - protein, 2170 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 609 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 610 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 611 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSEAAAKGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 612 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSPAPGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 613 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 614 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 615 - protein, 2185 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 616 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 617 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 618 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 619 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 620 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 621 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGEAAAKPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 622 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 623 - protein, 2168 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 624 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 625 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 626 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 627 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 628 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSEAAAKGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 629 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 630 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 631 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 632 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 633 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSPAPEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 634 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGPAPGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 635 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 636 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 637 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 638 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 639 - protein, 2172 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 640 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 641 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPEAAAKGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 642 - protein, 2173 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 643 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 644 - protein, 2171 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 645 - protein, 2174 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 646 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGSGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGLLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 647 - protein, 2211 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 648 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSGGGGSGGGGSGGGGSGGGGSGGGGSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 649 - protein, 2190 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 650 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 651 - protein, 2195 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKEAAAKEAAAKEAAAKEAAAKEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 652 - protein, 2198 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSSGGSSGSETPGTSESATPESSGGSSGGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 653 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 654 - protein, 2178 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGPAPAPAPAPAPAPGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 655 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGSSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 656 - protein, 2181 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGSETPGTSESATPESGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 657 - protein, 2177 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAGSAAGSGEFGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 658 - protein, 2168 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 659 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSGGGEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 660 - protein, 2180 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGEAAAKGGGGSEAAAKGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 661 - protein, 2176 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSEAAAKGGGGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

SEQ ID NO: 662 - protein, 2183 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSSGSSGSSGSSGSSGSSGGMDPLQLLQPLEAEIKGTKLKAHWNSGATITCVPQAFLEEEVPIKNIWIKTIHGEKEQPVYYLTFKIQGRKVEAEVISSPYDYILVSPSDIPWLMKKPLQLTTLVPLQEYEERLLKQTMLTGSYKEKLQSLFLKYDALWQHWENQVGHRRIKPHHIATGTVNPRPQKQYPINPKAKASIQTVINDLLKQGVLIQQNSIMNTPVYPVPKPDGKWRMVLDYREVNKTIPLIAAQNQHSAGILSSIFRGKYKTTLDLSNGFWAHSITPESYWLTAFTWLGQQYCWTRLPQGFLNSPALFNADVVDLLKEVPNVQVYVDDIYISHDDPREHLEQLEKVFSLLLNAGYVVSLKKSEIAQHEVEFLGFNITKEGRGLTETFKQKLLNITPPRDLKQLQSILGKLNFARNFIPNFSELVKPLYNIIATAPGKYITWTTDNSQQLQNIISMLNSAENLEERNPEVRLIMKVNTSPSAGYIRFYNEFAKRPIMYLNYVYTKAEVKFTNTEKLLTTIHKGLIKALDLGMGQEILVYSPIVSMTKIQKTPLPERKALPIRWITWMSYLEDPRIQFHYDKTLPELQQVPTVTDDIIAKIKHPSEFSMVFYTDGSAIKHPNVNKSHNAGMGIAQVQFKPEFTVINTWSIPLGDHTAQLAEVAAVEFACKKALKIDGPVLIVTDSFYVAESVNKELPYWQSNGFFNNKKKPLKHVSKWKSIADCIQLKPDIIIIHEKGHQPTASTFHTEGNNLADKLATQGSYVVNAGKRTADGSEFEKRTADGSEFESPKKKAKVE

(The sequence listing continues in the following parts.)

The invention claimed is:

1. A gene modifying polypeptide comprising: a reverse transcriptase (RT) domain having the sequence of SEQ ID NO: 8,113; a Cas9 nickase domain, wherein the RT domain is C-terminal of the Cas9 nickase domain; and a linker disposed between the RT domain and the Cas9 nickase domain, wherein the linker comprises the sequence of SEQ ID NO: 15,404.

2. The gene modifying polypeptide of claim 1, wherein the Cas9 nickase domain is a SpyCas9 nickase domain.

3. The gene modifying polypeptide of claim 1, wherein the Cas9 nickase domain comprises an N863A mutation.

4. The gene modifying polypeptide of claim 1, wherein the Cas9 nickase domain comprises the amino acid sequence of SEQ ID NO: 11,096.

5. The gene modifying polypeptide of claim 1, wherein the Cas9 nickase domain is an NmeCas9 domain.

6. The gene modifying polypeptide of claim 1, wherein the Cas9 nickase domain is an St1Cas9 domain.

7. The gene modifying polypeptide of claim 1, wherein the Cas9 nickase domain is a SauCas9 domain.

8. The gene modifying polypeptide of claim 1, which comprises a nuclear localization signal (NLS).

9. The gene modifying polypeptide of claim 1, which comprises a first NLS which is N-terminal of the Cas9 nickase domain.

10. The gene modifying polypeptide of claim 1, which comprises an NLS which is C-terminal of the RT domain.

11. The gene modifying polypeptide of claim 1, which comprises a first NLS which is N-terminal of the Cas9 nickase domain and a second NLS which is C-terminal of the RT domain.

12. The gene modifying polypeptide of claim 1, which comprises a first NLS which is N-terminal of the Cas9 nickase domain, wherein the first NLS comprises the amino acid sequence of

PAAKRVKLD. (SEQ ID NO: 11,095)

13. The gene modifying polypeptide of claim 1, which comprises an NLS which is C-terminal of the RT domain and comprises the amino acid sequence of KRTADGSEFE (SEQ ID NO: 4650).

14. The gene modifying polypeptide of claim 1, which comprises an NLS which is C-terminal of the RT domain and comprises the amino acid sequence of

KRTADGSEFESPKKKAKVE. (SEQ ID NO: 4651)

15. The gene modifying polypeptide of claim 1, which comprises the amino acid sequence of SEQ ID NO: 4000 which comprises a first NLS and the Cas9 nickase domain.

16. The gene modifying polypeptide of claim 1, which comprises an NLS having the amino acid sequence according to SEQ ID NO: 4649.

17. The gene modifying polypeptide of claim 1, which comprises a GG amino acid sequence between the Cas9 nickase domain and the linker.

18. The gene modifying polypeptide of claim 11, which comprises an AG amino acid sequence between the RT domain and the second NLS.

19. The gene modifying polypeptide of claim 1, which comprises a GG amino acid sequence between the linker and the RT domain.

20. The gene modifying polypeptide of claim 1, which comprises the amino acid sequence according to SEQ ID NO: 647.

21. A nucleic acid molecule encoding a gene modifying polypeptide comprising: a reverse transcriptase (RT) domain having the sequence of SEQ ID NO: 8,113; a Cas9 nickase domain, wherein the RT domain is C-terminal of the Cas9 nickase domain; and a linker disposed between the RT domain and the Cas9 nickase domain, wherein the linker comprises a sequence of SEQ ID NO: 15,404.

22. The nucleic acid molecule of claim 21, which comprises RNA.

23. A cell comprising: i) a gene modifying polypeptide comprising: a reverse transcriptase (RT) domain having the sequence of SEQ ID NO: 8,113; a Cas9 nickase domain, wherein the RT domain is C-terminal of the Cas9 nickase domain; and a linker disposed between the RT domain and the Cas9 nickase domain, wherein the linker comprises a sequence of SEQ ID NO: 15,404 or ii) a nucleic acid encoding the gene modifying polypeptide.

24. A system comprising:
i) a gene modifying polypeptide comprising: a reverse transcriptase (RT) domain having the sequence of SEQ ID NO: 8,113; a Cas9 nickase domain, wherein the RT domain is C-terminal of the Cas9 nickase domain; and a linker disposed between the RT domain and the Cas9 nickase domain, wherein the linker comprises a sequence of SEQ ID NO: 15,404, or a nucleic acid molecule encoding the gene modifying polypeptide, and
ii) a template RNA that comprises:
a) a gRNA spacer that is complementary to a portion of a target nucleic acid sequence;
b) a gRNA scaffold that binds the Cas9 nickase domain of the gene modifying polypeptide;
c) a heterologous object sequence; and
d) a primer binding site sequence.

25. A lipid nanoparticle formulation comprising the system of claim 24.

26. A method for modifying a target nucleic acid molecule in a cell, the method comprising contacting the cell with the system of claim 24, thereby modifying the target nucleic acid molecule.

* * * * *

UNITED STATES PATENT AND TRADEMARK OFFICE
CERTIFICATE OF CORRECTION

PATENT NO. : 12,024,728 B2
APPLICATION NO. : 18/356013
DATED : July 2, 2024
INVENTOR(S) : Robert Charles Altshuler et al.

Page 1 of 1

It is certified that error appears in the above-identified patent and that said Letters Patent is hereby corrected as shown below:

In the Claims

At Column 659, Claim number 12, Line number 51-55, delete
"acid sequence of (SEQ ID NO: 11,095) PAAKRVKLD." and insert
--acid sequence of PAAKRVKLD (SEQ ID NO: 11,095).--.

At Column 659, Claim number 14, Line number 62-66, delete
"acid sequence of (SEQ ID NO: 4651) KRTADGSEFESPKKKAKVE." and insert
--acid sequence of KRTADGSEFESPKKKAKVE (SEQ ID NO: 4651).--.

At Column 660, Claim number 23, Line number 44, delete "sequence of SEQ ID NO: 8.113; a Cas9 nickase domain," and insert --sequence of SEQ ID NO: 8,113; a Cas9 nickase domain,--.

At Column 660, Claim number 24, Line numbers 53-54, delete "transcriptase (RT) domain having the sequence of SEQ ID NO: 8.113; a Cas9 nickase domain," and insert --transcriptase (RT) domain having the sequence of SEQ ID NO: 8,113; a Cas9 nickase domain,--.

Signed and Sealed this
Twenty-second Day of October, 2024

Katherine Kelly Vidal
*Director of the United States Patent and Trademark Office*